United States Patent
Chu et al.

(10) Patent No.: US 11,851,691 B2
(45) Date of Patent: Dec. 26, 2023

(54) FUSION PROTEIN FOR REMODELING ANTIBODY GLYCOFORM

(71) Applicant: CHO PHARMA INC., Taipei (TW)

(72) Inventors: Kuo-Ching Chu, Taipei (TW); Lin-Ya Huang, Taipei (TW); Yi-Fang Zeng, Taipei (TW)

(73) Assignee: CHO PHARMA INC., Taipei (TW)

( * ) Notice: Subject to any disclaimer, the term of this patent is extended or adjusted under 35 U.S.C. 154(b) by 199 days.

(21) Appl. No.: 16/986,015

(22) Filed: Aug. 5, 2020

(65) Prior Publication Data

US 2021/0040463 A1 Feb. 11, 2021

Related U.S. Application Data

(60) Provisional application No. 62/882,729, filed on Aug. 5, 2019.

(51) Int. Cl.
*C12N 9/24* (2006.01)
*C12N 15/52* (2006.01)

(52) U.S. Cl.
CPC ........... *C12N 9/2402* (2013.01); *C12N 15/52* (2013.01); *C07K 2319/00* (2013.01); *C12Y 302/01051* (2013.01); *C12Y 302/01127* (2013.01)

(58) Field of Classification Search
CPC ...... C12N 9/2402; C12N 15/52; C12N 15/62; C07K 2319/00; C12Y 302/01051; C12Y 302/01127
See application file for complete search history.

(56) References Cited

U.S. PATENT DOCUMENTS

| 2018/0057804 A1 | 3/2018 | Lin et al. |
| 2019/0040374 A1 | 2/2019 | Geel et al. |
| 2019/0185898 A1 | 6/2019 | Wang et al. |

FOREIGN PATENT DOCUMENTS

| EP | 3323886 A1 | 5/2018 |
| JP | 2017-507664 A | 3/2017 |
| JP | 2018-509390 A | 5/2018 |
| TW | 201823455 A | 7/2018 |
| WO | 2015184008 A1 | 12/2015 |
| WO | WO 2017/137459 A1 * | 8/2017 |

OTHER PUBLICATIONS

Li, Chao et al., 'Chemoenzymatic defucosylation of therapeutic antibodies for enhanced effector functions using bacterial α-Fucosidases', Antibody Engineering, 2018, vol. 1827, pp. 367-380.
Li, Tiezheng et al., 'Glycosynthase mutants of endoglycosidase S2 show potent transglycosylation activity and remarkably relaxed substrate specificity for antibody glycosylation remodeling', Journal of Biological Chemistry, 2016, vol. 291, No. 32, pp. 16508-16518.
International Search Report for International Patent Application No. PCT/US2020/045054, dated Nov. 13, 2020.
Japanese Office action for copending JP application No. 2021-573284 dated Mar. 28, 2023.
Australian Office Action for copending AU application No. 2020325204 dated May 18, 2023.
Baishan Fang, et al.: Codon-Optimized NADH Oxidase Gene Expression and Gene Fusion with Glycerol Dehydro-genase for Bienzyme System with Cofactor Regeneration: PLOS One: Research Article: Jun. 26, 2015: pp. 1-15.
Thomas Heine, et al.: Engineering Styrene Monooxygenase for Biocatalysis: Reductase-Epoxidase Fusion Proteins: Appl Biochem Biotechnol: Received: Aug. 2, 2016 /Accepted: Oct. 24, 2016: Springer Science+Business Media New York 2016: pp. 1-26.
Office Action dated Jul. 10, 2023 for the EP counterpart (Application No. 20851035.4).
Kawaguchi T. et al: Novel Endos Mutant Enzyme, XP093058771, Database accession No. LQ715730.
Tsung-I Tsai et al: "An effective Bacterial Fucosidase for Glycoprotein Remodeling", ACS Chemical Biology, vol. 12, No. 1, Jan. 20, 2017, p. 63-72, XP055423715.
TieZheng Li et al; "Glycosynthase Mutants of Endoglucosidase S2 Show Potent Transglycosylation Activity and Remarkably Relaxed Substrate Specificity for Antibody Glycosylation Remodeling", Journal of Biological Chemistry, vol. 291, No. 32, Jun. 10, 2016, p. 16508-16518, XP055705912.
TieZheng Li et al; "modulating IgG effector function by Fc glycan engineering", Proceedings of the National Academy of Sciences, vol. 114, No. 13, Mar. 13, 2017, p. 3485-3490, XP055428860.
Office Action in Taiwan application 109126600 dated Jan. 31, 2023.
Search Report in Taiwan application 109126600 dated Jan. 31, 2023.
Chao Li et al., "Chemoenzymatic Defucosylation of Therapeutic Antibodies for Enhanced Effector Functions Using Bacterial α-Fucosidases." Methods Mol Biol. Sep. 2018;1827:367-380.

* cited by examiner

*Primary Examiner* — Iqbal H Chowdhury
(74) *Attorney, Agent, or Firm* — LADAS & PARRY LLP

(57) ABSTRACT

The present disclosure provides a fusion protein comprising a fucosidase or a truncated fragment or a mutant thereof fuses with either N-terminal end or C-terminal end of the endoglycosidase or a truncated fragment of mutant thereof. The present disclosure also provides a nucleic acid molecule expressing the fusion protein and a method for remodeling a glycan of an antibody Fc region.

14 Claims, 7 Drawing Sheets

Specification includes a Sequence Listing.

FUSION PROTEIN FOR REMODELING ANTIBODY GLYCOFORM

This application claims the benefit and priority to U.S. Provisional Application No. 62/882,729, filed on Aug. 5, 2019, entitled, "Advanced Fucosidase for Cleaving Core-Fucose of Ab-Fc", the contents of which is incorporated by reference herewith in its entirety.

SEQUENCE LISTING

The present disclosure contains a Sequence Listing which has been submitted electronically in ASCII format and is hereby incorporated by reference in its entirety. The Sequence Listing is submitted under the name, "G4590-09600US_SeqList_Amnd.txt" and is 1,537 kilobytes in size.

FIELD OF THE DISCLOSURE

The present disclosure relates to glycoform remodeling; particularly, to a fusion protein for remodeling antibody glycoform.

BACKGROUND OF THE DISCLOSURE

Antibodies, also known as immunoglobulins (Ig), are glycoproteins that play a central role in immune responses. IgG antibodies and fragments of IgG antibodies have been developed as important bio-therapeutics for treating a diverse range of diseases. The constant (Fc) region of naturally-occurring antibodies is typically N-glycosylated. The particular glycosylation, i.e., glycoform, significantly affects Fc effector functions and stability of the antibodies. Thus, one approach to improve therapeutic efficacy of an antibody is to modify the glycoform in the Fc region.

The Fc glycoform typically includes a core fucose residue. In the case of cancer therapy, it has been reported that anti-tumor antibodies having glycoforms in the Fc region with lower levels of core fucose demonstrate higher binding affinity to CD16 (FcγRIIIA) on NK cells. The higher affinity results in an improved induction of antibody-dependent cellular cytotoxicity against tumor cells.

To produce antibodies with a low level of core fucose, several strategies have been developed. For example, an inhibitor of fucosyltransferase, which is necessary for core fucose addition, can be added to the culture medium used for growing antibody producing cells. In another example, antibody producing cells can be genetically engineered to lack fucosyltransferase activity.

In a different strategy, purified enzymes can be used is vitro to directly modify the antibody glycoform in a predictable way. One advantage of this strategy is that antibodies can be produced and then modified to have well-defined low core fucose Fc glycoforms with desirable biological properties. This would facilitate the use of high-yielding non-mammalian expression systems to produce antibodies instead of mammalian expression systems, which are typically employed to ensure proper core glycosylation. US 20190185898 provides for fucosidase mutants that serve as fuco-ligases for core fucosylation of a range of biological glycopeptides and glycoproteins including intact therapeutic antibodies.

Yet, existing fucosidase enzymes are inefficient at cleaving core fucose from the Fc region. The need exists to develop enzymes that can efficiently and predictably remodel antibody glycoform.

SUMMARY OF THE DISCLOSURE

A fusion protein is provided in the disclosure. The assembly of multiple enzymes in a fusion protein facilitates enzyme synergism and exhibits advantageous effect of remodeling antibody glycoform predictably.

In one aspect, the present disclosure provides a fusion protein comprising a fucosidase or a truncated fragment or a mutant thereof fuses with either N-terminal end or C-terminal end of the endoglycosidase or a truncated fragment or a mutant thereof; wherein the fusion protein exhibit both the fucosidase activity and the endoglycosidase activity.

Certain embodiments of the fucosidase include, but are not limited to, *Lactobacillus casei* α-L fucosidase C (Alfc), *Bacteroides fragilis* fucosidase (BF3242), *Bacteroides thetaiotaomicron* α-L-fucosidase (BT2970), *Emticicia oligotrophica* α-L-fucosidase (EO0918) and *Elizabethkingia miricola* α-(1-6) fucosidase (Emfuc3), or a fragment thereof, or a mutant thereof. In some embodiments, the fucosidase is *Lactobacillus casei* α-L fucosidase C, *Elizabethkingia miricola* α-(1-6) fucosidase (Emfuc3), or a truncated fragment thereof, or a mutant thereof.

Certain embodiments of the endoglycosidase include, but are not limited to, *Streptococcus pyogenes* endoglycosidase S, *Streptococcus pyogenes* endoglycosidase S2 or a fragment or a mutant thereof. Particularly, the endoglycosidase is *Streptococcus pyogenes* endoglycosidase S2, or a truncated fragment or a mutant thereof.

In one embodiment, the fucosidase or endoglycosidase is a truncated fragment. Truncated fragment of endoglycosidase is the IgG binding domain thereof. In some embodiments, the truncated fragment of the endoglycosidase is an IgG binding domain of *Streptococcus pyogenes* endoglycosidase S or *Streptococcus pyogenes* endoglycosidase S2.

In one embodiment, the fucosidase or endoglycosidase is a mutant polypeptide. Particularly, the endoglycosidase mutant is *Streptococcus pyogenes* endoglycosidase S having a mutation at amino acid position –D233, preferably –D233Q. In some embodiments, the endoglycosidase mutant is *Streptococcus pyogenes* endoglycosidase S2 having a mutation at amino acid position T138, D182, D184, D186, D226, or T227; preferably having a T138E, T138M, T138Q, T138R, T138M, T138L, T138H, T138N, T138K, D182Q, D184M, D184Q, D184T, D184L, D184F, D184S, D184V, D184K, D184W, E186A, D226Q, or T227Q.

Certain embodiments of the fusion protein include, but are not limited to, *Lactobacillus casei* α-L fucosidase C fused with *Streptococcus pyogenes* endoglycosidase S, *Streptococcus pyogenes* endoglycosidase S2, an IgG binding domain of *Streptococcus pyogenes* endoglycosidase S, an IgG binding domain of *Streptococcus pyogenes* endoglycosidase S2, *Streptococcus pyogenes* endoglycosidase S having a mutation at amino acid position D233, *Streptococcus pyogenes* endoglycosidase S2 having a mutation at amino acid position T138, *Streptococcus pyogenes* endoglycosidase S2 having a mutation at amino acid position D182, *Streptococcus pyogenes* endoglycosidase S2 having a mutation at amino acid position D184, *Streptococcus pyogenes* endoglycosidase S2 having a mutation at amino acid position D186, *Streptococcus pyogenes* endoglycosidase S2 having a mutation at amino acid position D226, or *Streptococcus pyogenes* endoglycosidase S2 having a mutation at amino acid position T227.

Particularly, the fusion protein comprises an amino acid sequence selected from the group consisting of: SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, and 204, or a substantially similar sequence thereof. Preferably, the fusion protein has the amino acid sequence selected from the group consisting of SEQ ID NOs: 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 174, 176, 178, 180, 182, 184, 186, 188, 190, 192, 194, 196, 198, 200, 202, and 204, or a substantially similar sequence thereof.

In another aspect, the present disclosure provides a nucleic acid molecule expressing the fusion protein as described herein. Certain embodiments of the nucleic acid include, but are not limited to, SEQ ID NOs: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, and 203, or a substantially identical sequence thereof. In some further embodiments, the nucleic acid has the nucleotide sequence selected from the group consisting of SEQ ID NOs: 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 173, 175, 177, 179, 181, 183, 185, 187, 189, 191, 193, 195, 197, 199, 201, and 203, or a substantial identical sequence thereof.

In another aspect, the present disclosure provides a vector comprising the nucleic acid of the present disclosure. The present disclosure also provides a host cell comprising the vector.

In a further aspect, the present disclosure provides a method for remodeling a glycan of a Fc region of an antibody comprising the following steps: obtaining an antibody that has a heterogeneous glycan in the Fc region of the antibody and contacting the antibody with the fusion protein as described herein. Particularly, the method comprises providing an antibody having a heterogeneous glycan in the Fc region thereof, a fusion protein as described herein and a target glycan oxazoline, wherein the glycan of the antibody Fc region comprises a N-acetylglucosamine (GlcNAc) residue; and contacting the antibody with the fusion protein and the target glycan oxazoline linking to the antibody Fc region; whereby a remodeled glycan of the antibody Fc region can be obtained.

In one embodiment of the disclosure, the method further comprises purifying the antibody having the remodeled glycan in the Fc region.

The present disclosure is described in detail in the following sections. Other characteristics, purposes and advantages of the present disclosure can be found in the detailed description and claims.

DETAILED DESCRIPTION OF THE DISCLOSURE

Figure 1:
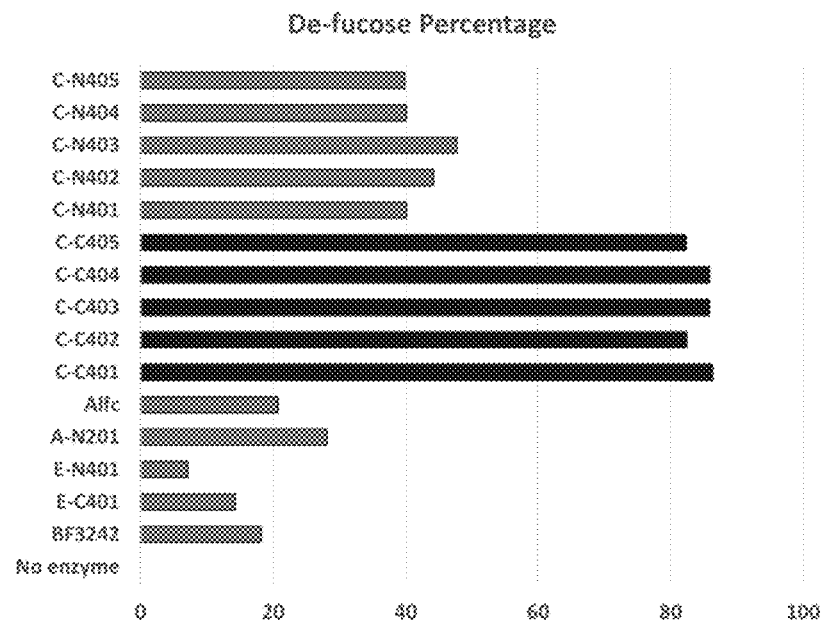
FIG. 1 shows a bar graph showing percentage of fucose hydrolysis by the indicated enzymes, i.e., fucosidases, and fucosidase/EndoS2 fusion proteins, expressed as percentage of starting fucose removed. The enzymes are identified in Tables 1 to 5 below.

The Fc domain of all IgGs possesses a conserved N-glycosylation site to which a biantennary complex-type glycan is typically attached, but significant structural heterogeneity arises from terminal and core modifications. Certain glycoforms of a human antibody exhibit improved therapeutic effects while others possess undesired properties. Therefore, the ability to control the glycosylation process plays a crucial role to obtain antibodies comprising desired glycoform(s) so as to improve their therapeutic efficacy. The present disclosure provides a fusion protein comprising a plurality of enzymes for remodeling antibody glycoforms, following which a glycopeptide having a glycosylation pattern suitable for therapeutic use in a mammal can be generated.

The practice of the present invention will employ, unless otherwise indicated, conventional techniques of molecular biology, microbiology, recombinant DNA, and immunology, which are within the skill of the art. Such techniques are explained fully in the literature. See, for example, Molecular Cloning A Laboratory Manual, 2nd Ed., ed. by Sambrook, Fritsch and Maniatis (Cold Spring Harbor Laboratory Press, 1989); DNA Cloning, Volumes I and II (D. N. Glover ed., 1985); Culture Of Animal Cells (R. I. Freshney, Alan R. Liss, Inc., 1987); Immobilized Cells And Enzymes (IRL Press, 1986); B. Perbal, A Practical Guide To Molecular Cloning (1984); the treatise, Methods In Enzymology (Academic Press, Inc., N.Y.); Gene Transfer Vectors For Mammalian Cells (J. H. Miller and M. P. Calos eds., 1987, Cold Spring Harbor Laboratory); Methods In Enzymology, Vols. 154 and 155 (Wu et al. eds.), Immunochemical Methods In Cell And Molecular Biology (Mayer and Walker, eds., Academic Press, London, 1987); Antibodies: A Laboratory Manual, by Harlow and Lane s (Cold Spring Harbor Laboratory Press, 1988); and Handbook Of Experimental Immunology, Volumes I-IV (D. M. Weir and C. C. Blackwell, eds., 1986).

Definitions

The present disclosure can be more readily understood by reference to the following detailed description of various embodiments of the disclosure, the examples, and the drawings and tables with their relevant descriptions. It is to be understood that unless otherwise specifically indicated by the claims, the disclosure is not limited to specific preparation methods, carriers or formulations, or to particular modes of formulating the extract of the disclosure into products or compositions intended for topical, oral or parenteral administration, because as one of ordinary skill in the relevant arts is well aware, such things can, of course, vary. It is also to be understood that the terminology used herein is for the purpose of describing particular embodiments only and is not intended to be limiting.

As utilized in accordance with the present disclosure, the following terms, unless otherwise indicated, shall be understood to have the following meaning.

It must be noted that, as used in the specification and the appended claims, the singular forms "a," "an" and "the" include plural referents unless the context clearly dictates otherwise. Thus, unless otherwise required by context, singular terms shall include the plural and plural terms shall include the singular.

As used herein, the term "optional" or "optionally" means that the subsequently described event or circumstance may or may not occur, and that the description includes instances where the said event or circumstance occurs and instances where it does not. For example, the phrase "optionally comprising an agent" means that the agent may or may not exist.

As used herein, the term "glycan" refers to a polysaccharide, or oligosaccharide. Glycan is also used herein to refer to the carbohydrate portion of a glycoconjugate, such as a glycoprotein, glycolipid, glycopeptide, glycoproteome, peptidoglycan, lipopolysaccharide or a proteoglycan. Glycans usually consist solely of O-glycosidic linkages between monosaccharides. For example, cellulose is a glycan (or more specifically a glucan) composed of -1,4-linked D-glucose, and chitin is a glycan composed of -1,4-linked N-acetyl-D-glucosamine. Glycans can be homo or heteropolymers of monosaccharide residues, and can be linear or branched. Glycans can be found attached to proteins as in glycoproteins and proteoglycans. They are generally found on the exterior surface of cells. O- and N-linked glycans are very common in eukaryotes but may also be found, although less commonly, in prokaryotes. N-Linked glycans are found attached to the R-group nitrogen (N) of asparagine in the sequon. The sequon is a Asn-X-Ser or Asn-X-Thr sequence, where X is any amino acid except praline.

As used herein, the term "engineered" describes a polypeptide whose amino acid sequence has been designed by man and/or whose existence and production require human intervention and/or activity.

As used herein, the term "polynucleotide," or "nucleic acid," as used interchangeably herein, refer to polymers of nucleotides of any length, and include DNA and RNA. The nucleotides can be deoxyribonucleotides, ribonucleotides, modified nucleotides or bases, and/or their analogs, or any substrate that can be incorporated into a polymer by DNA or RNA polymerase, or by a synthetic reaction. A polynucleotide may comprise modified nucleotides, such as methylated nucleotides and their analogs. If present, modification to the nucleotide structure may be imparted before or after assembly of the polymer. The sequence of nucleotides may be interrupted by non-nucleotide components. A polynucleotide may be further modified after synthesis, such as by conjugation with a label. Other types of modifications include, for example, "caps," substitution of one or more of the naturally occurring nucleotides with an analog, internucleotide modifications such as, for example, those with uncharged linkages (e.g., methyl phosphonates, phosphotriesters, phosphoamidates, carbamates, etc.) and with charged linkages (e.g., phosphorothioates, phosphorodithioates, etc.), those containing pendant moieties, such as, for example, proteins (e.g., nucleases, toxins, antibodies, signal peptides, ply-L-lysine, etc.), those with intercalators (e.g., acridine, psoralen, etc.), those containing chelators (e.g., metals, radioactive metals, boron, oxidative metals, etc.), those containing alkylators, those with modified linkages (e.g., alpha anomeric nucleic acids, etc.), as well as unmodified forms of the polynucleotides(s). Further, any of the hydroxyl groups ordinarily present in the sugars may be replaced, for example, by phosphonate groups, phosphate groups, protected by standard protecting groups, or activated to prepare additional linkages to additional nucleotides, or may be conjugated to solid or semi-solid supports. The 5' and 3' terminal OH can be phosphorylated or substituted with amines or organic capping group moieties of from 1 to 20 carbon atoms. Other hydroxyls may also be derivatized to standard protecting groups. Polynucleotides can also contain analogous forms of ribose or deoxyribose sugars that are generally known in the art, including, for example, 2'-O-methyl-, 2'-O-allyl, 2'-fluoro- or 2'-azido-ribose, carbocyclic sugar analogs, .alpha.-anomeric sugars, epimeric sugars such as arabinose, xyloses or lyxoses, pyranose sugars, furanose sugars, sedoheptuloses, acyclic analogs and basic nucleoside analogs such as methyl riboside. One or more phosphodiester linkages may be replaced by alternative linking groups. These alternative linking groups include, but are not limited to, embodiments wherein phosphate is replaced by P(O)S ("thioate"), P(S)S ("dithioate"), "(O)NR$_2$ ("amidate"), P(O)R, P(O)OR', CO or CH$_2$ ("formacetal"), in which each R or R' is independently H or substituted or unsubstituted alkyl (1-20 C) optionally containing an ether (—O—) linkage, aryl, alkenyl, cycloalkyl, cycloalkenyl or araldyl. Not all linkages in a polynucleotide need be identical. The preceding description applies to all polynucleotides referred to herein, including RNA and DNA.

As used herein, the term "vector" refers to a nucleic acid molecule capable of transporting another nucleic acid to which it has been linked.

As used herein, the term "host" refers to a system (e.g., a cell, organism, etc.) in which a polypeptide of interest is present. In some embodiments, a host is a system that is susceptible to infection with a particular infectious agent. In some embodiments, a host is a system that expresses a particular polypeptide of interest.

As used herein, the term "amino acid" refers to naturally occurring and synthetic amino acids, as well as amino acid analogs and amino acid mimetics that function in a manner similar to the naturally occurring amino acids. Naturally occurring amino acids are those encoded by the genetic code, as well as those amino acids that are later modified, e.g., hydroxyproline, (-carboxyglutamate, and O-phosphoserine. Amino acid analogs refers to compounds that have the same basic chemical structure as a naturally occurring amino acid, i.e., an .alpha. carbon that is linked to a hydrogen, a carboxyl group, an amino group, and an R group, e.g., homoserine, norleucine, methionine sulfoxide, methionine methyl sulfonium. Such analogs have modified R groups (e.g., norleucine) or modified peptide backbones, but retain the same basic chemical structure as a naturally occurring amino acid. Amino acid mimetics refers to chemical compounds that have a structure that is different from the general chemical structure of an amino acid, but that function in a manner similar to a naturally occurring amino acid.

As used herein, the term "polypeptide," "peptide," and "protein," as used interchangeably herein, can be used refers to a polymer in which the monomers are amino acids and are joined together through amide bonds, alternatively referred to as a peptide. Additionally, unnatural amino acids, for example, beta-alanine, phenylglycine and homoarginine are also included. Amino acids that are not nucleic acid-encoded may also be used in the present invention. Furthermore, amino acids that have been modified to include reactive groups, glycosylation sites, polymers, therapeutic moieties, biomolecules and the like may also be used in the invention.

All of the amino acids used in the present invention may be either the D- or L-isomer thereof. The L-isomer is generally preferred. In addition, other peptidomimetics are also useful in the present invention. As used herein, a "peptide" is an oligopeptide, polypeptide, peptide, protein or glycoprotein. As used herein, "polypeptide" refers to both glycosylated and unglycosylated peptides. Also included are peptides that are incompletely glycosylated by a system that expresses the peptide.

As used herein, the term "a fusion protein," also known as "a chimeric protein," refers to a protein that is translated from the joining of two or more genes that originally coded for separate proteins.

As used herein, the term "antibody", as used herein, also includes an antigen-binding fragment of a full antibody molecule. An antigen-binding fragment of an antibody may be derived, e.g., from full antibody molecules using any suitable standard techniques such as proteolytic digestion or recombinant genetic engineering techniques involving the manipulation and expression of DNA encoding antibody variable and optionally constant domains. Such DNA is known and/or is readily available from, e.g., commercial sources, DNA libraries (including, e.g., phage-antibody libraries), or can be synthesized. The DNA may be sequenced and manipulated chemically or by using molecular biology techniques, for example, to arrange one or more variable and/or constant domains into a suitable configuration, or to introduce codons, create cysteine residues, modify, add or delete amino acids, etc.

As used herein, the term "an antibody Fc region" refers to a fragment crystallizable region, which is the tail region of an antibody that interacts with cell surface receptors called Fc receptors and some proteins of the complement system. Glycosylation of the Fc fragment is essential for Fc receptor-mediated activity.

As used herein, the term "glycoform" refers to an antibody comprising a particular glycosylation state. The term "glycosylation state" refers to an antibody having a specific or desired glycosylation pattern.

As used herein, the term "remodeling a glycan of an antibody Fc region" refers to changing or modifying the type, position, number, form, or linkage of residues in the glycan of the antibody Fc region. In one embodiment, the remodeling is lowering the number or length of core fucose.

As used herein, the term "a target glycan oxazoline" refers to a glycan oxazoline which is the glycoform to be remodeled.

Fusion Proteins

Glycosylation pathway engineering has been developed to improve the biological function and reduce the heterogenecity of therapeutic antibodies. The way to acquire homogeneous glycoproteins is based on the strategy of glycoprotein remodeling. Fucosidases are able to catalyze the hydrolysis of an α-L fucoside. For example, the hydrolysis of the α-L fucoside involves the chemical reaction of cleaving the 1,2-linkage, 1,3-linkage, or 1,6-linkage between α-L-fucose and N-acetylglucosamine residue. On the other hand, endoglycosidases catalyze the release of oligosaccharides from glycoproteins or glycolipids. For example, the release of oligosaccharides from glycoproteins is performed by hydrolyzing the β-1,4-di-N-acetylchitobiose core of the asparagine-linked glycan or hydrolyzing the endo-β-N-acetylglucosaminide on all N-linked glycans and on biantennary and sialylated glycans of AGP (α1-acid glycoprotein). Fucosidases and endoglycosidases in combination to treat antibody glycoforms can obtain homogeneous antibodies with a well-defined glycan at the Fc region.

The present disclosure provides a fusion protein comprising a fucosidase or a truncated fragment or a mutant thereof fuses with either N-terminal end or C-terminal end of the endoglycosidase or a truncated fragment or a mutant thereof; wherein the fusion protein exhibits both the fucosidase activity and the endoglycosidase activity.

The fucosidase or a truncated fragment of mutant thereof and the endoglycosidase or a truncated fragment or a mutant thereof are fused together directly or through a linker. In one embodiment, the fucosidase or a truncated fragment or a mutant thereof directly or indirectly links to the N-terminal of the endoglycosidase or a truncated fragment or a mutant thereof. In another embodiment, the fucosidase or a truncated fragment or a mutant thereof directly or indirectly links to the C-terminal of the endoglycosidase or a truncated fragment or a mutant thereof.

Fucosidase can be in a wild type form or a modified form compared to its wild-type form, such as a truncated fragment or a mutant thereof. Examples of the fucosidase include but are not limited to *Lactobacillus casei* α-L fucosidase C (Alfc), *Bacteroides fragilis* fucosidase (BF3242), *Bacteroides thetaiotaomicron* α-L-fucosidase (BT2970), *Emticicia oligotrophica* α-L-fucosidase (EO0918) and *Elizabethkingia miricola* α-(1-6) fucosidase (Emfuc3), or a fragment thereof, or a mutant thereof. In some embodiments, the fucosidase is *Lactobacillus casei* α-L fucosidase C and *Elizabethkingia miricola* α-(1-6) fucosidase (Emfuc3), and a truncated fragment or a mutant thereof.

Endoglycosidase can be in a wild type form or a modified form compared to its wild-type form, such as a truncated fragment or mutant of an endoglycosidase. Examples of the endoglycosidase include but are not limited to *Streptococcus pyogenes* endoglycosidase S, *Streptococcus pyogenes* endoglycosidase S2 or a fragment or a mutant thereof. In some embodiments, the endoglycosidase is *Streptococcus pyogenes* endoglycosidase S2, or a truncated fragment or a mutant thereof.

Truncated fragments of fucosidase or endoglycosidase can also be used in the present disclosure. The truncated fragments of fucosidase or endoglycosidase have been truncated at either the N-terminal end of the peptide, the C-terminal end of the peptide or at both ends, or an internal region of the peptide. In some embodiments, the truncated fragment of fucosidase or endoglycosidase is a C-terminal or N-terminal truncated fragment thereof. In one embodiment, the truncated fragment of endoglycosidase is the IgG binding domain thereof. In some further embodiments, the truncated fragment of the endoglycosidase is an IgG binding domain of *Streptococcus pyogenes* endoglycosidase S or *Streptococcus pyogenes* endoglycosidase S2.

The fucosidase or endoglycosidase can be a mutant form thereof. In one embodiment, the endoglycosidase mutant is *Streptococcus pyogenes* endoglycosidase S having a mutation at amino acid position −D233; preferably, having a mutation at amino acid position D233Q. In some embodiments, the endoglycosidase mutant is *Streptococcus pyogenes* endoglycosidase S2 having a mutation at amino acid position: T138, D182, D184, D186, D226, or T227; preferably having a T138E, T138M, T138Q, T138R, T138M, T138L, T138H, T138N, T138K, D182Q, D184M, D184Q, D184T, D184L, D184F, D184S, D184V, D184K, D184W, E186A, D226Q, or T227Q.

In some embodiments, the fusion protein comprises *Lactobacillus casei* α-L fucosidase C fused with *Streptococcus pyogenes* endoglycosidase S, *Streptococcus pyogenes* endoglycosidase S2, an IgG binding domain of *Streptococcus pyogenes* endoglycosidase S, an IgG binding domain of *Streptococcus pyogenes* endoglycosidase S2, *Streptococcus pyogenes* endoglycosidase S having a mutation at amino acid position D233, *Streptococcus pyogenes* endoglycosidase S2 having a mutation at amino acid position T138, *Streptococcus pyogenes* endoglycosidase S2 having a mutation at amino acid position D182, *Streptococcus pyogenes* endoglycosidase S2 having a mutation at amino acid position D184, *Streptococcus pyogenes* endoglycosidase S2 having a mutation at amino acid position D186, *Streptococcus pyogenes* endoglycosidase S2 having a mutation at amino acid position D226, or *Streptococcus pyogenes* endoglycosidase S2 having a mutation at amino acid position T227.

In some embodiments, the fusion protein comprises *Elizabethkingia miricola* α-(1-6) fucosidase fused with *Streptococcus pyogenes* endoglycosidase S, *Streptococcus pyogenes* endoglycosidase S2, an IgG binding domain of *Streptococcus pyogenes* endoglycosidase S, an IgG binding domain of *Streptococcus pyogenes* endoglycosidase S2, *Streptococcus pyogenes* endoglycosidase S having a mutation at amino acid position D233, *Streptococcus pyogenes* endoglycosidase S2 having a mutation at amino acid position T138, *Streptococcus pyogenes* endoglycosidase S2 having a mutation at amino acid position D182, *Streptococcus pyogenes* endoglycosidase S2 having a mutation at amino acid position D184, *Streptococcus pyogenes* endoglycosidase S2 having a mutation at amino acid position D186, *Streptococcus pyogenes* endoglycosidase S2 having a mutation at amino acid position D226 or *Streptococcus pyogenes* endoglycosidase S2 having a mutation at amino acid position T227.

Examples of the amino acid sequence of the fusion protein include but are not limited to SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, and 204, or a substantially similar sequence thereof. Preferably, the fusion protein has the amino acid sequence selected from the group consisting of SEQ ID NOs: 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 174, 176, 178, 180, 182, 184, 186, 188, 190, 192, 194, 196, 198, 200, 202, and 204, or a substantially similar sequence thereof.

As applied to polypeptides, the term "substantial similarity" or "substantially similar" applied to polypeptides means that two peptide sequences, when optimally aligned, such as by the programs GAP or BESTFIT using default gap weights, share at least 95% sequence identity, even more preferably at least 98% or 99% sequence identity. Preferably, residue positions which are not identical differ by conservative amino acid substitutions. A "conservative amino acid substitution" is one in which an amino acid residue is substituted by another amino acid residue having a side chain (R group) with similar chemical properties (e.g., charge or hydrophobicity). In general, a conservative amino acid substitution will not substantially change the functional properties of a protein. In cases where two or more amino acid sequences differ from each other by conservative substitutions, the percent sequence identity or degree of similarity may be adjusted upwards to correct for the conservative nature of the substitution. Means for making this adjustment are well-known to those of skill in the art. Examples of groups of amino acids that have side chains with similar chemical properties include (1) aliphatic side chains: glycine, alanine, valine, leucine and isoleucine; (2) aliphatic-hydroxyl side chains: serine and threonine; (3) amide-containing side chains: asparagine and glutamine; (4) aromatic side chains: phenylalanine, tyrosine, and tryptophan; (5) basic side chains: lysine, arginine, and histidine; (6) acidic side chains: aspartate and glutamate, and (7) sulfur-containing side chains are cysteine and methionine. Preferred conservative amino acids substitution groups are: valine-leucine-isoleucine, phenylalanine-tyrosine, lysine-arginine, alanine-valine, glutamate-aspartate, and asparagine-glutamine.

Mutations may be a substitution, deletion, or insertion of one or more codons encoding the antibody or polypeptide that results in a change in the amino acid sequence as compared with the native sequence antibody or polypeptide. Standard techniques known to those of skill in the art can be used to introduce mutations in the nucleotide sequence encoding a molecule provided herein, including, for example, site-directed mutagenesis and PCR-mediated mutagenesis which results in amino acid substitutions. Insertions or deletions may optionally be in the range of about 1 to 5 amino acids. In certain embodiments, the substitution, deletion, or insertion includes fewer than 25 amino acid substitutions, fewer than 20 amino acid substitutions, fewer than 15 amino acid substitutions, fewer than 10 amino acid substitutions, fewer than 5 amino acid substitutions, fewer than 4 amino acid substitutions, fewer than 3 amino acid substitutions, or fewer than 2 amino acid substitutions relative to the original molecule. The variation allowed may be determined by systematically making insertions, deletions, or substitutions of amino acids in the sequence and testing the resulting variants for activity exhibited by the full-length or mature native sequence.

Amino acid sequence insertions include amino- and/or carboxyl-terminal fusions ranging in length from one residue to polypeptides containing a hundred or more residues, as well as intrasequence insertions of single or multiple amino acid residues. Examples of terminal insertions include an antibody with an N-terminal methionyl residue. Other insertional variants of the antibody molecule include the fusion to the N- or C-terminus of the antibody to an enzyme (e.g., for antibody-directed enzyme prodrug therapy) or a polypeptide which increases the serum half-life of the antibody.

A conservative amino acid substitution is one in which the amino acid residue is replaced with an amino acid residue having a side chain with a similar charge. Families of amino acid residues having side chains with similar charges have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). Alternatively, mutations can be introduced randomly along all or part of the coding sequence, such as by saturation mutagenesis, and the resultant mutants can be screened for biological activity to identify mutants that retain activity. Following mutagenesis, the encoded protein can be expressed and the activity of the protein can be determined.

Substantial modifications in the biological properties of the antibody are accomplished by selecting substitutions that differ significantly in their effect on maintaining (a) the structure of the polypeptide backbone in the area of the substitution, for example, as a sheet or helical conformation, (b) the charge or hydrophobicity of the molecule at the target site, or (c) the bulk of the side chain.

Non-conservative substitutions entail exchanging a member of one of these classes for another class. Such substituted residues also may be introduced into the conservative substitution sites or, into the remaining (non-conserved) sites.

The mutations can be made using methods known in the art such as oligonucleotide-mediated (site-directed) mutagenesis, alanine scanning, and PCR mutagenesis. Site-directed mutagenesis (see, e.g., Carter, 1986, Biochem J. 237:1-7; and Zoller et al., 1982, Nucl. Acids Res. 10:6487-500), cassette mutagenesis (see, e.g., Wells et al., 1985, Gene 34:315-23), or other known techniques can be performed on the cloned DNA to produce the variant DNA.

Nucleic Acid Molecules Encoding the Fusion Protein of the Present Disclosure and the Expression Systems Producing the Fusion Protein of the Present Disclosure The present disclosure also provides a nucleic acid molecule expressing the fusion protein as described herein.

In some embodiments of the disclosure, the nucleic acid molecule has the nucleotide sequence selected from the group consisting of SEQ ID NOs: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, and 203, or a substantially identical sequence thereof. In some further embodiments, the nucleic acid has the nucleotide sequence selected from the group consisting of SEQ ID NOs: 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 173, 175, 177, 179, 181, 183, 185, 187, 189, 191, 193, 195, 197, 199, 201, and 203, or a substantial identical sequence thereof.

The term "substantial identity" or "substantially identical," when referring to a nucleic acid or a fragment thereof, indicates that, when optimally aligned with appropriate nucleotide insertions or deletions with another nucleic acid (or its complementary strand), there is nucleotide sequence identity in at least 95%, and more preferably at least 96%, 97%, 98% or 99% of the nucleotide bases to the entire sequence of said reference nucleic acid sequence as measured by any well-known algorithm of sequence identity, such as FASTA, BLAST or Gap, as discussed below. A nucleic acid molecule having substantial identity to a reference nucleic acid molecule may, in certain instances, encode a polypeptide having the same or substantially similar amino acid sequence as the polypeptide encoded by the reference nucleic acid molecule.

The fusion protein can be produced using various expression systems, including prokaryotic and eukaryotic expression systems. Many such systems are widely available from commercial suppliers. In one embodiment, the fusion protein may be expressed using a vector, wherein the polynucleotide encoding said fusion protein is operably linked to a promoter sequence. In one embodiment, the promoter is a constitutive promoter. In another embodiment, the promoter is an inducible promoter.

In one embodiment, the polynucleotide or vector is contained in a virus. In another embodiment, the virus is selected from the group consisting of a retrovirus, a lentivirus, an adenovirus, and an adeno-associated virus. In one preferred embodiment of the disclosure, the polynucleotide or vector is contained in an adeno-associated virus (AAV) shuttle plasmid.

Applications of the Fusion Protein of the Present Disclosure

The present disclosure provides a method for remodeling a glycan of a Fc region of an antibody comprising the following steps: obtaining an antibody that has a heterogeneous glycan in the Fc region of the antibody and contacting the antibody with the fusion protein as described herein.

In one embodiment of the disclosure, the method comprises:
  providing an antibody having a heterogeneous glycan in the Fc region thereof, a fusion protein of the present disclosure and a target glycan oxazoline, wherein the glycan of the antibody Fc region comprises a N-acetylglucosamine (GlcNAc) residue linking to an Asn residue of Fc region; preferably, the glycan of the antibody Fc region comprises a N-acetylglucosamine (GlcNAc) residue linking to an Asn-297 of Fc region.
  contacting the antibody with the fusion protein and the target glycan oxazoline linking to the antibody Fc region;
  whereby a remodeled glycan of the antibody Fc region can be obtained.

In one embodiment, the target glycan oxazoline replaces a portion of the glycan of the Fc region for linking to the antibody Fc region. It is believed, though not intended to be restricted by any theoretical that the fusion protein according to the disclosure removes the N-linked GlcNAc in the glycan of the antibody Fc region, and then a glycosylation occurs for adding the target glycan oxazoline to the antibody Fc region. Therefore, a remodeled glycan of the antibody Fc region can be obtained.

Examples of the remodeled glycan include but are not limited to $Sia_2(\alpha2-6)Gal_2GlcNAc_2Man_3GlcNAc_2$, $Sia_2(\alpha2-6)Gal_2GlcNAc_3Man_3GlcNAc_2$, $Sia_2(\alpha2-3)Gal_2GlcNAc_2Man_3GlcNAc_2$, $Sia_2(\alpha2-3)Gal_2GlcNAc_3Man_3GlcNAc_2$, $Sia_2(\alpha2-3/\alpha2-6)Gal_2GlcNAc_2Man_3GlcNAc_2$, $Sia_2(\alpha2-6/\alpha2-3)Gal_2GlcNAc_2Man_3GlcNAc_2$, $Sia_2(\alpha2-3/\alpha2-6)Gal_2GlcNAc_3Man_3GlcNAc_2$, $Sia_2(\alpha2-6/\alpha2-3)Gal_2GlcNAc_3Man_3GlcNAc_2$, $Sia(\alpha2-6)Gal_2GlcNAc_2Man_3GlcNAc_2$, $Sia(\alpha2-3)Gal_2GlcNAc_2Man_3GlcNAc_2$, $Sia(\alpha2-6)Gal_2GlcNAc_3Man_3GlcNAc_2$, $Sia(\alpha2-3)Gal_2GlcNAc_3Man_3GlcNAc_2$, $Sia(\alpha2-6)GalGlcNAc_2Man_3GlcNAc_2$, $Sia(\alpha2-3)GalGlcNAc_2Man_3GlcNAc_2$, $Sia(\alpha2-6)GalGlcNAc_3Man_3GlcNAc_2$, $Sia(\alpha2-3)GalGlcNAc_3Man_3GlcNAc_2$, $Gal_2GlcNAc_2Man_3GlcNAc_2$, $GalGlcNAcMan_3GlcNAc_2$, $Gal_2GlcNAc_3Man_3GlcNAc_2$, $GalGlcNAc_2Man_3GlcNAc_2$, $GalGlcNAc_3Man_3GlcNAc_2$, $GlcNAc_3Man_3GlcNAc_2$, $GlcNAc_2Man_3GlcNAc_2$, $GlcNAcMan_3GlcNAc_2$, or $Man_3GlcNAc_2$.

Preferably, the method further comprises purifying the antibody with Fc region having the remodeled glycan.

Aspects of the present invention are additionally described by way of the following illustrative non-limiting examples that provide a better understanding of embodiments of the present invention and of its many advantages. The following examples are included to demonstrate preferred embodiments of the invention. It should be appreciated by those of skill in the art that the techniques disclosed in the examples which follow represent techniques used in the present invention to function well in the practice of the invention, and thus can be considered to constitute preferred modes for its practice. However, those of skill in the art should appreciate, in light of the present disclosure that many changes can be made in the specific embodiments which are disclosed and still obtain a like or similar result without departing from the spirit and scope of the invention.

EXAMPLES

Fusion Proteins

Example 1: Production of Fusion Proteins

Fusion proteins were produced that contain full length or truncated (IgG binding motif only) EndoS or EndoS2 fused to fucosidase BF3242 (Table 1), Alfc (Table 2), BT2970 (Table 3), EO0918 (Table 4), and Emfuc3 (Table 5) as shown below in Tables 1 to 5.

TABLE 1

BF3242 Fusion proteins

| Enzyme Code | Construct N-terminal | C-terminal | N.A. SEQ ID NO | A.A. SEQ ID NO |
|---|---|---|---|---|
| A-C101 | EndoS$^{IgG-BD\ (a)}$ | BF3242 | 1 | 2 |
| A-C201 | EndoS2$^{IgG-BD\ (a)}$ | | 3 | 4 |
| D-C101 | EndoS$^{WT\ (b)}$ | | 5 | 6 |
| D-C201 | EndoS$^{D233Q}$ | | 7 | 8 |
| E-C101 | EndoS2$^{WT\ (b)}$ | | 9 | 10 |
| E-C201 | EndoS2$^{T138E}$ | | 11 | 12 |
| E-C204 | EndoS2$^{T138M}$ | | 13 | 14 |
| E-C401 | EndoS2$^{D184M}$ | | 15 | 16 |
| A-N101 | BF3242 | EndoS$^{IgG-BD\ (a)}$ | 17 | 18 |
| A-N201 | | EndoS2$^{IgG-BD\ (a)}$ | 19 | 20 |
| D-N101 | | EndoS$^{WT\ (b)}$ | 21 | 22 |
| D-N201 | | EndoS$^{D233Q}$ | 23 | 24 |
| E-N101 | | EndoS2$^{WT\ (b)}$ | 25 | 26 |
| E-N201 | | EndoS2$^{T138E}$ | 27 | 28 |
| E-N204 | | EndoS2$^{T138M}$ | 29 | 30 |
| E-N401 | | EndoS2$^{D184M}$ | 31 | 32 |

$^{(a)}$ IgG binding domain of endoS or endoS2 only
$^{(b)}$ wild type endoS or endoS2

TABLE 2

Alfc Fusion proteins

| Enzyme Code | Construct N-terminal | C-terminal | N.A. SEQ ID NO | A.A. SEQ ID NO |
|---|---|---|---|---|
| A-C102 | EndoS$^{IgG-BD}$ | Alfc | 33 | 34 |
| A-C202 | EndoS2$^{IgG-BD}$ | | 35 | 36 |
| B-C101 | EndoS$^{WT}$ | | 37 | 38 |
| B-C201 | EndoS$^{D233Q}$ | | 39 | 40 |
| C-C101 | EndoS2$^{WT}$ | | 41 | 42 |
| C-C201 | EndoS2$^{T138E}$ | | 43 | 44 |
| C-C202 | EndoS2$^{T138Q}$ | | 45 | 46 |
| C-C203 | EndoS2$^{T138R}$ | | 47 | 48 |
| C-C204 | EndoS2$^{T138M}$ | | 49 | 50 |
| C-C205 | EndoS2$^{T138L}$ | | 51 | 52 |
| C-C206 | EndoS2$^{T138H}$ | | 53 | 54 |
| C-C207 | EndoS2$^{T138N}$ | | 55 | 56 |
| C-C208 | EndoS2$^{T138K}$ | | 57 | 58 |
| C-C301 | EndoS2$^{D182Q}$ | | 59 | 60 |
| C-C401 | EndoS2$^{D184M}$ | | 61 | 62 |
| C-C402 | EndoS2$^{D184Q}$ | | 63 | 64 |
| C-C403 | EndoS2$^{D184T}$ | | 65 | 66 |
| C-C404 | EndoS2$^{D184L}$ | | 67 | 68 |
| C-C405 | EndoS2$^{D184F}$ | | 69 | 70 |
| C-C406 | EndoS2$^{D184S}$ | | 71 | 72 |
| C-C407 | EndoS2$^{D184V}$ | | 73 | 74 |
| C-C408 | EndoS2$^{D184K}$ | | 75 | 76 |

TABLE 2-continued

Alfc Fusion proteins

| Enzyme Code | Construct N-terminal | Construct C-terminal | N.A. SEQ ID NO | A.A. SEQ ID NO |
|---|---|---|---|---|
| C-C409 | EndoS2$^{D184W}$ | | 77 | 78 |
| C-C410 | EndoS2$^{D184M}$_L2$^{(a)}$ | | 79 | 80 |
| C-C411 | EndoS2$^{D184M}$_L4$^{(b)}$ | | 81 | 82 |
| C-C501 | EndoS2$^{E186A}$ | | 83 | 84 |
| C-C601 | EndoS2$^{D226Q}$ | | 85 | 86 |
| C-C701 | EndoS2$^{T227Q}$ | | 87 | 88 |
| A-N102 | Alfc | EndoS$^{IgG-BD}$ | 89 | 90 |
| A-N202 | | EndoS2$^{IgG-BD}$ | 91 | 92 |
| B-N101 | | EndoS$^{WT}$ | 93 | 94 |
| B-N201 | | EndoS$^{D233Q}$ | 95 | 96 |
| C-N101 | | EndoS2$^{WT}$ | 97 | 98 |
| C-N401 | | EndoS2$^{D184M}$ | 99 | 100 |
| C-N402 | | EndoS2$^{D184Q}$ | 101 | 102 |
| C-N403 | | EndoS2$^{D184T}$ | 103 | 104 |
| C-N404 | | EndoS2$^{D184L}$ | 105 | 106 |
| C-N405 | | EndoS2$^{D184F}$ | 107 | 108 |

$^{(a)}$L2 stands for [GGGGS]$_2$ (linkage of fusion protein)
$^{(b)}$L4 stands for [GGGGS]$_4$ (linkage of fusion protein)

TABLE 3

BT2970 Fusion proteins

| Enzyme Code | Construct N-terminal | Construct C-terminal | N.A. SEQ ID NO | A.A. SEQ ID NO |
|---|---|---|---|---|
| A-C103 | EndoS$^{IgG-BD}$ | BT2970 | 109 | 110 |
| A-C203 | EndoS2$^{IgG-BD}$ | | 111 | 112 |
| F-C101 | EndoS$^{WT}$ | | 113 | 114 |
| F-C201 | EndoS$^{D233Q}$ | | 115 | 116 |
| G-C101 | EndoS2$^{WT}$ | | 117 | 118 |
| G-C201 | EndoS2$^{T138E}$ | | 119 | 120 |
| G-C204 | EndoS2$^{T138M}$ | | 121 | 122 |
| G-C401 | EndoS2$^{D184M}$ | | 123 | 124 |
| A-N103 | BT2970 | EndoS$^{IgG-BD}$ | 125 | 126 |
| A-N203 | | EndoS2$^{IgG-BD}$ | 127 | 128 |
| F-N101 | | EndoS$^{WT}$ | 129 | 130 |
| F-N201 | | EndoS$^{D233Q}$ | 131 | 132 |
| G-N101 | | EndoS2$^{WT}$ | 133 | 134 |
| G-N201 | | EndoS2$^{T138E}$ | 135 | 136 |
| G-N204 | | EndoS2$^{T138M}$ | 137 | 138 |
| G-N401 | | EndoS2$^{D184M}$ | 139 | 140 |

TABLE 4

EO0918 Fusion proteins

| Enzyme Code | Construction N-terminal | Construction C-terminal | N.A. SEQ ID NO | A.A. SEQ ID NO |
|---|---|---|---|---|
| A-C104 | EndoS$^{IgG-BD}$ | EO0918 | 141 | 142 |
| A-C204 | EndoS2$^{IgG-BD}$ | | 143 | 144 |
| H-C101 | EndoS$^{WT}$ | | 145 | 146 |
| H-C201 | EndoS$^{D233Q}$ | | 147 | 148 |
| I-C101 | EndoS2$^{WT}$ | | 149 | 150 |
| I-C201 | EndoS2$^{T138E}$ | | 151 | 152 |
| I-C204 | EndoS2$^{T138M}$ | | 153 | 154 |
| I-C401 | EndoS2$^{D184M}$ | | 155 | 156 |
| A-N104 | EO0918 | EndoS$^{IgG-BD}$ | 157 | 158 |
| A-N204 | | EndoS2$^{IgG-BD}$ | 159 | 160 |
| H-N101 | | EndoS$^{WT}$ | 161 | 162 |
| H-N201 | | EndoS$^{D233Q}$ | 163 | 164 |
| I-N101 | | EndoS2$^{WT}$ | 165 | 166 |
| I-N201 | | EndoS2$^{T138E}$ | 167 | 168 |
| I-N204 | | EndoS2$^{T138M}$ | 169 | 170 |
| I-N401 | | EndoS2$^{D184M}$ | 171 | 172 |

TABLE 5

Emfuc3 Fusion proteins

| Enzyme Code | Construction N-terminal | Construction C-terminal | N.A. SEQ ID NO | A.A. SEQ ID NO |
|---|---|---|---|---|
| A-C105 | EndoS$^{IgG-BD}$ | Emfuc3 | 173 | 174 |
| A-C205 | EndoS2$^{IgG-BD}$ | | 175 | 176 |
| J-C101 | EndoS$^{WT}$ | | 177 | 178 |
| J-C201 | EndoS$^{D233Q}$ | | 179 | 180 |
| K-C101 | EndoS2$^{WT}$ | | 181 | 182 |
| K-C201 | EndoS2$^{T138E}$ | | 183 | 184 |
| K-C204 | EndoS2$^{T138M}$ | | 185 | 186 |
| K-C401 | EndoS2$^{D184M}$ | | 187 | 188 |
| A-N105 | Emfuc3 | EndoS$^{IgG-BD}$ | 189 | 190 |
| A-N205 | | EndoS2$^{IgG-BD}$ | 191 | 192 |
| J-N101 | | EndoS$^{WT}$ | 193 | 194 |
| J-N201 | | EndoS$^{D233Q}$ | 195 | 196 |
| K-N101 | | EndoS2$^{WT}$ | 197 | 198 |
| K-N201 | | EndoS2$^{T138E}$ | 199 | 200 |
| K-N204 | | EndoS2$^{T138M}$ | 201 | 202 |
| K-N401 | | EndoS2$^{D184M}$ | 203 | 204 |

Remodeling a Glycan of an Antibody Fc Region.

Example 2: Fucosidase Activity Assay

A test antibody, i.e., trastuzumab (TRZ), was treated with endoS2 in Tris-HCl (pH 7.0) at 37° C. for 1 hour. The treated antibody was purified by adsorbing onto a protein A affinity chromatography resin (MabSelect™), washing with Tris-HCl (pH 7.4), and eluting with citric acid buffer (pH 3.0). Most of the residual glycan in the Fc region of the resulting antibody is N-acetylglucosamine-fucose (GlcNAc-Fuc). The purified antibody was treated with fusion proteins or native fucosidases in Tris-HCl buffer (pH 7.0) at 37° C. for 16 h, followed by heating at 55° C. for 20 min to inactivate enzymatic activities. The reaction mixtures were filtered through a 0.22 μm membrane and the treated antibodies were purified by affinity chromatography.

The levels of residual fucose were determined by analysis of intact protein mass. The ratio of TRZ-N/N (TRZ which contains two GlcNAc in the Fc region), TRZ-N/NF (TRZ which contains one GlcNAc and one GlcNAc-Fuc in the Fc region), and TRZ-NF/NF (TRZ which contains two GlcNAc-Fuc in the Fc region) was identified by the intensities of each mass peak. The results are shown below in Table 6 and in FIG. 1.

TABLE 6

Percentage of fucose removed from test antibody TRZ

| Enzyme | | | Analyses of Fucose by Intact Mass Intensity | | | | |
|---|---|---|---|---|---|---|---|
| | Construction | | N/N | N/NF | NF/NF | Fucose | De-fucose Percentage |
| Enzyme Code | N-terminal | C-terminal | (%) | (%) | (%) | Level (%) | by Enzyme (%) |
| None | No enzyme | | 7.16 | 15.29 | 77.55 | 85.2 | 0 |
| BF3242 | BF3242 | | 12.34 | 35.99 | 51.67 | 69.67 | 18.22 |
| E-C401 | EndoS2$^{D184M}$ | BF3242 | 10.78 | 32.5 | 56.72 | 72.97 | 14.35 |
| E-N401 | BF3242 | EndoS2$^{D184M}$ | 8.72 | 24.29 | 66.99 | 79.14 | 7.11 |
| A-N201 | BF3242 | EndoS2$^{IgG-BD}$ | 18.23 | 41.14 | 40.63 | 61.2 | 28.17 |
| Alfc | Alfc | | 13.76 | 37.38 | 48.86 | 67.55 | 20.72 |
| C-C401 | EndoS2$^{D184M}$ | Alfc | 80.96 | 14.85 | 4.18 | 11.61 | 86.37 |
| C-C402 | EndoS2$^{D184Q}$ | Alfc | 75.29 | 19.56 | 5.15 | 14.93 | 82.48 |
| C-C403 | EndoS2$^{D184T}$ | Alfc | 79.97 | 16.03 | 4 | 12.02 | 85.89 |
| C-C404 | EndoS2$^{D184L}$ | Alfc | 80.23 | 15.55 | 4.22 | 12 | 85.92 |
| C-C405 | EndoS2$^{D184F}$ | Alfc | 75.37 | 19.32 | 5.32 | 14.98 | 82.42 |
| C-N401 | Alfc | EndoS2$^{D184M}$ | 26.75 | 44.59 | 28.66 | 50.96 | 40.19 |
| C-N402 | Alfc | EndoS2$^{D184Q}$ | 29.94 | 45.13 | 24.93 | 47.5 | 44.25 |
| C-N403 | Alfc | EndoS2$^{D184T}$ | 32.9 | 45.14 | 21.36 | 44.53 | 47.73 |
| C-N404 | Alfc | EndoS2$^{D184L}$ | 25.85 | 46.22 | 27.93 | 51.04 | 40.09 |
| C-N405 | Alfc | EndoS2$^{D184F}$ | 26.67 | 44.25 | 29.08 | 51.21 | 39.89 |

The results showed that fucosidase activity of *Bacteroides fragilis* fucosidase BF3242 was not improved by fusing it to an *S. pyogenes* endoS2 D184M mutant. Compare BF3242 (18.22% fucose removed) to E-C401 (14.35%) and E-N401 (7.11%).

Surprisingly, the fucosidase activity of Alfc was significantly increased by fusing this enzyme to either the N-terminus or the C-terminus of a D184 mutant endoS2 enzyme. For example, Alfc removed 20.72% of fucose from the test antibody, while Alfc fused to the N-terminus of the EndoS2 D184M mutant removed 40.19% of fucose. Compare Alfc with C-N401. More unexpectedly, Alfc fused to the C-terminus of EndoS2 D184M (C-C401) removed as much as 86.37% of fucose from the test antibody. Notably, all of the tested Alfc fusions at the C-terminus of EndoS2 D184 mutants, i.e., D184M, D184Q, D184T, D184L, and D184F, showed an unexpectedly high fucosidase activity, as compared to fusion of Alfc at the EndoS2 mutant N-terminus.

Example 3: Fucosidase Activity of Additional Alfc Fusion Proteins

Figure 2:
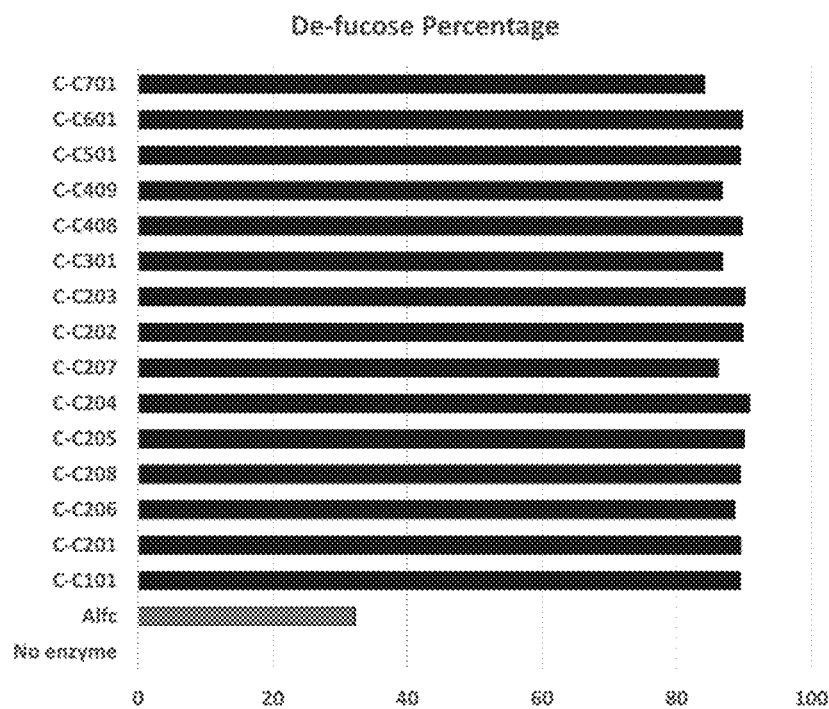
FIG. 2 shows a bar graph showing percentage of fucose hydrolysis by Alfc fucosidase or Alfc/EndoS2 fusion proteins expressed as percentage of starting fucose removed. The fusion proteins are identified in Tables 1 to 5 below.

Additional fusion proteins having Alfc fused to the C-terminus of native or site-specific mutant EndoS2 enzymes were tested for their fucosidase activity on TRZ as described above in Example 2. The results are shown below in Table 7 and in FIG. 2.

TABLE 7

Percentage of fucose removed from test antibody TRZ

| Enzyme | | | Analyses of Fucose by Intact Mass Intensity | | | | |
|---|---|---|---|---|---|---|---|
| | Construction | | | | | Fucose | De-fucose percentage |
| Enzyme Code | N-terminal | C-terminal | N/N | N/NF | NF/NF | Level | by enzyme |
| None | No enzyme | | 7.26 | 15.29 | 77.55 | 85.20 | 0 |
| L23C | Alfc only | | 20.40 | 43.67 | 35.92 | 57.76 | 32.21 |
| C-C101 | EndoS2$^{WT}$ | Alfc | 84.65 | 12.76 | 2.60 | 8.98 | 89.46 |
| C-C201 | EndoS2$^{T138E}$ | Alfc | 84.78 | 12.67 | 2.55 | 8.89 | 89.57 |
| C-C206 | EndoS2$^{T138H}$ | Alfc | 83.56 | 13.48 | 2.96 | 9.7 | 88.62 |
| C-C208 | EndoS2$^{T138K}$ | Alfc | 84.76 | 12.46 | 2.77 | 9 | 89.44 |
| C-C205 | EndoS2$^{T138L}$ | Alfc | 85.68 | 11.62 | 2.70 | 8.51 | 90.01 |
| C-C204 | EndoS2$^{T138M}$ | Alfc | 86.63 | 11.08 | 2.29 | 7.83 | 90.81 |
| C-C207 | EndoS2$^{T138N}$ | Alfc | 79.54 | 17.38 | 3.08 | 11.77 | 86.16 |
| C-C202 | EndoS2$^{T138Q}$ | Alfc | 85.30 | 12.11 | 2.59 | 8.65 | 89.85 |
| C-C203 | EndoS2$^{T138R}$ | Alfc | 85.75 | 11.71 | 2.55 | 8.41 | 90.13 |
| C-C301 | EndoS2$^{D182Q}$ | Alfc | 81.09 | 15.41 | 3.49 | 11.20 | 86.85 |
| C-C408 | EndoS2$^{D184K}$ | Alfc | 85.30 | 11.86 | 2.84 | 8.77 | 89.71 |
| C-C409 | EndoS2$^{D184W}$ | Alfc | 81.55 | 14.38 | 4.05 | 11.26 | 86.78 |
| C-C501 | EndoS2$^{E186A}$ | Alfc | 84.67 | 12.74 | 2.59 | 8.96 | 89.48 |
| C-C601 | EndoS2$^{D226Q}$ | Alfc | 85.49 | 11.65 | 2.87 | 8.70 | 89.79 |
| C-C701 | EndoS2$^{T227Q}$ | Alfc | 76.58 | 19.91 | 3.51 | 13.47 | 84.19 |

The results showed that all of the Alfc/EndoS2 fusion proteins tested removed significantly more fucose from TRZ, as compared to Alfc alone.

Figure 3:
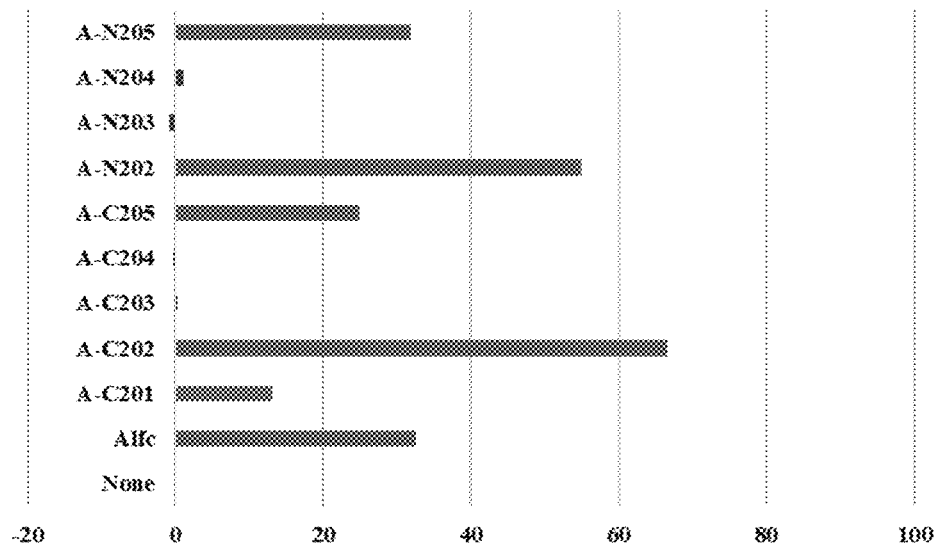
FIG. 3 shows a bar graph showing percentage of fucose hydrolysis by Alfc fucosidase or fusion proteins of five fucosidases with truncated EndoS2 expressed as percentage of starting fucose removed. The fusion proteins are identified in Tables 1 to 5 below.

Additional fusion proteins of five fucosidases with truncated EndoS2 were tested for their fucosidase activity on TRZ as described above in Example 2. The results are shown below, in Table 8 and in FIG. 3.

TABLE 8

Percentage of fucose removed from test antibody TRZ

| Enzyme Code | Enzyme Construction N-terminal | C-terminal | Analyses of Fucose by Heavy Chain Mass Intensity N (%) | NF (%) | De-fucose Percentage by Enzyme (%) |
| --- | --- | --- | --- | --- | --- |
| None | No enzyme | | 11.78 | 88.22 | 0 |
| Alfc | | Alfc | 40.45 | 59.55 | 32.5 |
| A-C201 | EndoS2$^{IgG-BD}$ | BF3242 | 23.29 | 76.71 | 13.05 |
| A-C202 | EndoS2$^{IgG-BD}$ | Alfc | 70.52 | 29.48 | 66.58 |
| A-C203 | EndoS2$^{IgG-BD}$ | BT2970 | 11.99 | 88.01 | 0.24 |
| A-C204 | EndoS2$^{IgG-BD}$ | EO0918 | 11.6 | 88.4 | −0.2 |
| A-C205 | EndoS2$^{IgG-BD}$ | Emfuc3 | 33.79 | 66.21 | 24.95 |
| A-N202 | Alfc | EndoS2$^{IgG-BD}$ | 60.24 | 39.76 | 54.93 |
| A-N203 | BT2970 | EndoS2$^{IgG-BD}$ | 11 | 89 | −0.88 |
| A-N204 | EO0918 | EndoS2$^{IgG-BD}$ | 12.8 | 87.2 | 1.16 |
| A-N205 | Emfuc3 | EndoS2$^{IgG-BD}$ | 39.91 | 60.09 | 31.89 |

The de-fucose capability of Alfc was improved obviously. The fusion proteins of BT2970 & EO0918 could not remove the core-fucose of antibody.

Figure 4:
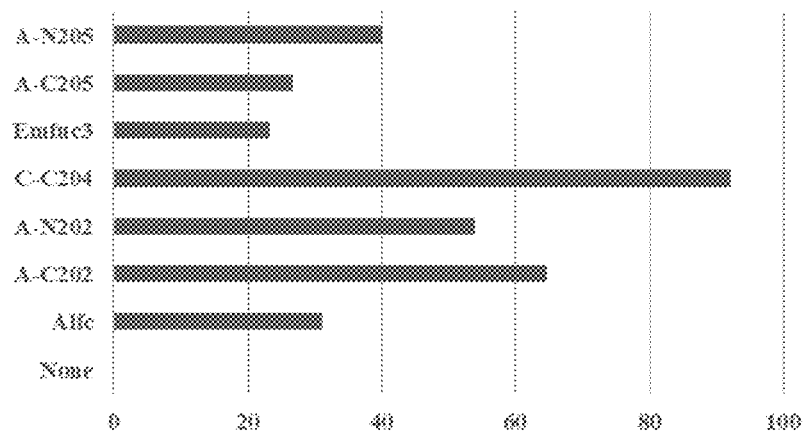
FIG. 4 shows a bar graph showing percentage of fucose hydrolysis by Alfc or Emfuc3 fucosidase or Alfc or Emfuc3/EndoS2 fusion proteins expressed as percentage of starting fucose removed. The fusion proteins are identified in Tables 1 to 5 below.

Example 4 Additional Fusion Proteins Having Alfc or Emfuc3 Fused to the Truncated EndoS2 or Site-Specific Mutant EndoS2 Enzymes Additional fusion proteins having Alfc or Emfuc3 fused to the truncated EndoS2 or site-specific mutant EndoS2 enzymes were tested for their fucosidase activity on TRZ as described above in Example 2. The results are shown below in Table 9 and in FIG. 4.

TABLE 9

Percentage of fucose removed from test antibody TRZ

| Enzyme Code | Enzyme Construction N-terminal | C-terminal | Analyses of Fucose by Heavy Chain Mass Intensity N (%) | NF (%) | De-fucose Percentage by Enzyme (%) |
| --- | --- | --- | --- | --- | --- |
| None | No enzyme | | 12.19 | 87.81 | 0 |
| Alfc | | Alfc | 39.47 | 60.53 | 31.07 |
| A-C202 | EndoS2$^{IgG-BD}$ | Alfc | 69.02 | 30.98 | 64.72 |
| A-N202 | Alfc | EndoS2$^{IgG-BD}$ | 59.46 | 40.54 | 53.83 |
| C-C204 | EndoS2$^{T138M}$ | Alfc | 93.03 | 6.97 | 92.06 |
| Emfuc3 | Emfuc3 | Emfuc3 | 32.52 | 67.48 | 23.15 |
| A-C205 | EndoS2$^{IgG-BD}$ | Emfuc3 | 35.52 | 64.48 | 26.57 |
| A-N205 | Emfuc3 | EndoS2$^{IgG-BD}$ | 47.38 | 52.62 | 40.08 |

The de-fucose capability of Alfc could be more increased when fused to C-terminal of intact EndoS2 mutations (C-C204), than truncated EndoS2 (IgG binding domain), A-C202 & A-N202. The de-fucose capability of Emfuc3 could be improved when fused to N-terminal of truncated EndoS2 (IgG binding domain), A-N205, but not when fused to C-terminal of truncated EndoS2 (IgG binding domain), A-C205.

Example 5

Figure 5:
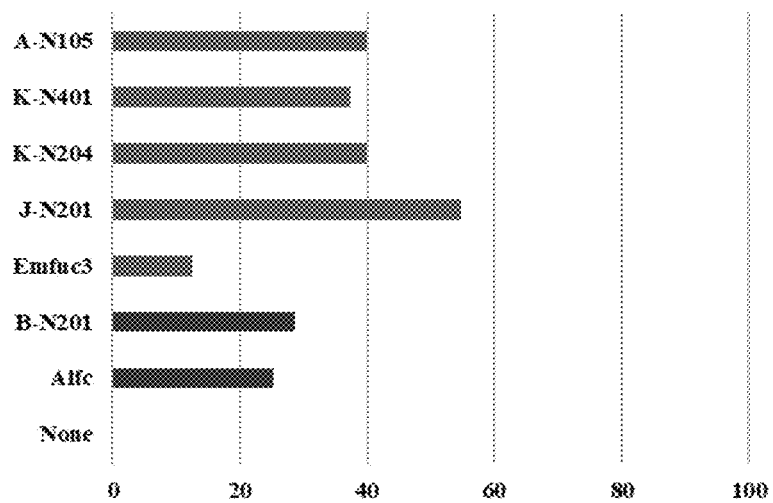
FIG. 5 shows a bar graph showing percentage of fucose hydrolysis by Alfc or Emfuc3 fucosidase, Alfc/EndoS or EndoS or EndoS2/Emfuc3 fusion proteins expressed as percentage of starting fucose removed. The fusion proteins are identified in Tables 1 to 5 below.

Additional fusion proteins having Alfc or Emfuc3 fused to the N-terminus of truncated or site-specific mutant EndoS or EndoS enzymes were tested for their fucosidase activity on TRZ as described above in Example 2. The results are shown below in Table 10 and in FIG. 5.

TABLE 10

Percentage of fucose removed from test antibody TRZ

| Enzyme | | | Analyses of Fucose by Heavy Chain Mass intensity | | |
|---|---|---|---|---|---|
| | Construction | | N | NF | De-fucose Percentage |
| Enzyme Code | N-terminal | C-terminal | (%) | (%) | by Enzyme (%) |
| None | No enzyme | | 10.4 | 89.6 | 0 |
| Alfc | | Alfc | 30.04 | 66.96 | 25.27 |
| B-N201 | Alfc | EndoS$^{D233Q}$ | 36.09 | 63.91 | 28.67 |
| Emfuc3 | | Emfuc3 | 21.6 | 78.4 | 12.5 |
| J-N201 | Emfuc3 | EndoS$^{D233Q}$ | 59.37 | 40.63 | 54.65 |
| K-N204 | Emfuc3 | EndoS2$^{T138M}$ | 46.17 | 53.83 | 39.92 |
| K-N401 | Emfuc3 | EndoS2$^{D184M}$ | 43.85 | 56.15 | 37.33 |
| A-N105 | Emfuc3 | EndoS$^{IgG-BD}$ | 46.17 | 53.83 | 39.92 |

The activity of Alfc was dramatic improved after fusing with EndoS2, but not improved after fusing with EndoS. In contrast, the activity of Emfuc3 was improved more obviously after fusing with EndoS rather than EndoS2.

Figure 6:
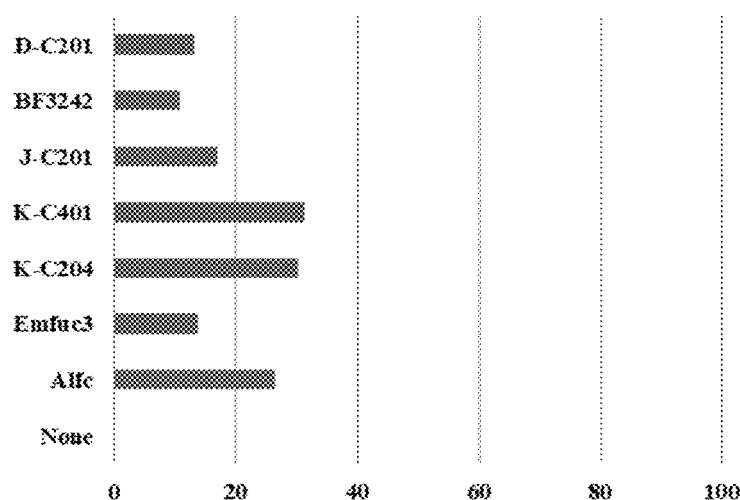
FIG. 6 shows a bar graph showing percentage of fucose hydrolysis by Alfc, Emfuc3 or BF3242 fucosidase, EndoS or EndoS2/Emfuc3 or EndoS/BF3242 fusion proteins expressed as percentage of starting fucose removed. The fusion proteins are identified in Tables 1 to 5 below.

Example 6 Additional Fusion Proteins Having EndoS or EndoS2/Emfuc3, EndoS/BF3242, Alfc, Emfuc3 or BF3242 Fucosidase Additional fusion proteins having EndoS or EndoS2/Emfuc3, EndoS/BF3242, Alfc, Emfuc3 or BF3242 fucosidase, enzymes were tested for their fucosidase activity on TRZ as described above in Example 2. The results are shown below in Table 11 and in FIG. 6.

TABLE 11

Percentage of fucose removed from test antibody TRZ

| Enzyme | | | Analyses of Fucose by Heavy Chain Mass intensity | | |
|---|---|---|---|---|---|
| | Construction | | N | NF | De-fucose Percentage |
| Enzyme Code | N-terminal | C-terminal | (%) | (%) | by Enzyme (%) |
| None | No enzyme | | 10.12 | 89.88 | 0 |
| Alfc | | Alfc | 33.81 | 66.19 | 26.36 |
| Emfuc3 | | Emfuc3 | 22.48 | 77.52 | 13.75 |
| K-C204 | EndoS2$^{T138M}$ | Emfuc3 | 37.19 | 62.81 | 30.12 |
| K-C401 | EndoS2$^{D184M}$ | Emfuc3 | 38.13 | 61.87 | 31.16 |
| J-C201 | EndoS$^{D233Q}$ | Emfuc3 | 25.32 | 74.68 | 16.91 |
| BF3242 | | BF3242 | 19.72 | 80.28 | 10.68 |
| D-C201 | EndoS$^{D233Q}$ | BF3242 | 21.83 | 78.17 | 13.03 |

Comparing with Example 5, more significant improvement was observed when fusing Emfuc3 with N-terminal of EndoS-mutation and EndoS2-mutation than fusing to C-terminal of endoglycosidase.

Figure 7:
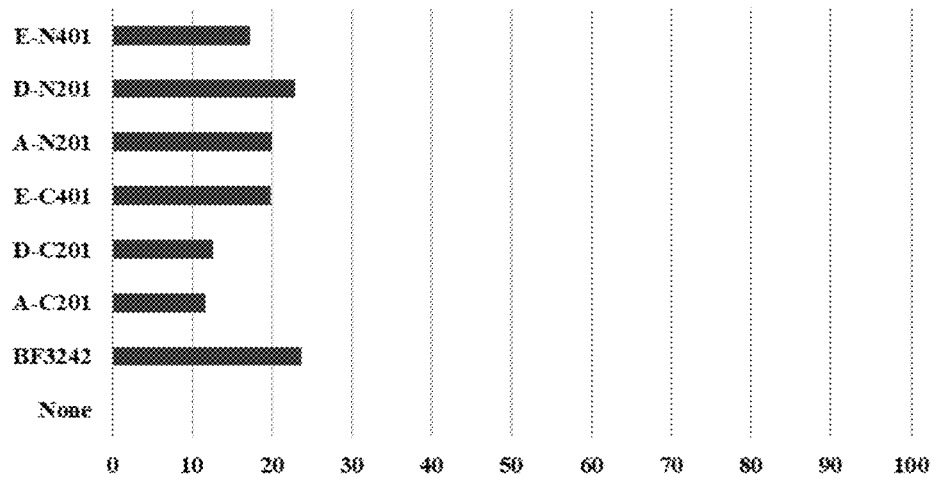
FIG. 7 shows a bar graph showing percentage of fucose hydrolysis by BF3242 fucosidase, EndoS or EndoS2/BF3242 fusion proteins expressed as percentage of starting fucose removed. The fusion proteins are identified in Tables 1 to 5 below.

Example 7 Additional Fusion Proteins Having BF3242 Fused to the Truncated or Site-Specific Mutant EndoS2 or EndoS Enzymes Additional fusion proteins having BF3242 fused to the truncated or site-specific mutant EndoS2 or EndoS enzymes were tested for their fucosidase activity on TRZ as described above in Example 2. The results are shown below in Table 12 and in FIG. 7.

TABLE 12

Percentage of fucose removed from test antibody TRZ

| Enzyme | | | Analyses of Fucose by Heavy Chain Mass intensity | | |
| --- | --- | --- | --- | --- | --- |
| Enzyme Code | Construction N-terminal | C-terminal | N (%) | NF (%) | De-fucose Percentage by Enzyme (%) |
| None | No enzyme | | 13.05 | 86.95 | 0 |
| BF3242 | BF3242 | | 33.67 | 66.33 | 23.71 |
| A-C201 | EndoS2$^{IgG\text{-}BD}$ | BF3242 | 23.15 | 76.85 | 11.62 |
| D-C201 | EndoS$^{D233Q}$ | BF3242 | 23.9 | 76.1 | 12.48 |
| E-C401 | EndoS2$^{D184M}$ | BF3242 | 30.27 | 69.73 | 19.8 |
| A-N201 | BF3242 | EndoS2$^{IgG\text{-}BD}$ | 30.43 | 69.57 | 20 |
| D-N201 | BF3242 | EndoS$^{D233Q}$ | 32.95 | 67.05 | 22.89 |
| E-N401 | BF3242 | EndoS2$^{D184M}$ | 27.99 | 72.01 | 17.18 |

The de-core-fucose capability of BF3242 could not be improved by fusing with endoglycosidase.

Example 8 Glyco-Engineering of TRZ by Fusion Protein, C-C401

Test antibody TRZ was treated with fusion protein C-C401, i.e., Alfc fused to the C-terminus of endoS2 D184M, in Tris-HCl (pH 7.0) at 37° C. for 16 h to 20 h. After adjusting the reaction to 30° C., a sialylated complex type glycan-oxazoline, i.e., Sia$_2$(α2-6)Gal$_2$GlcNAc$_2$ Man$_3$ GlcNAc-oxazoline or the non-sialylated version (Gal$_2$ GlcNAc$_2$Man$_3$GlcNAc-oxazoline) was added and the reaction incubated for 30 min to 1 h. The glyco-engineered TRZ was purified as described above in Example 2. The resulting glyco-engineered TRZ contained two Sia$_2$(α2-6) Gal$_2$GlcNAc$_2$Man$_3$GlcNAc$_2$ (G2S2) or two Gal$_2$ GlcNAc$_2$Man$_3$GlcNAc$_2$ (G2) in the Fc region. Samples of the reactions were removed at different time intervals and analyzed by SDS-PAGE. The results are presented in FIGS. 8A and 8B.

Figure 8A:
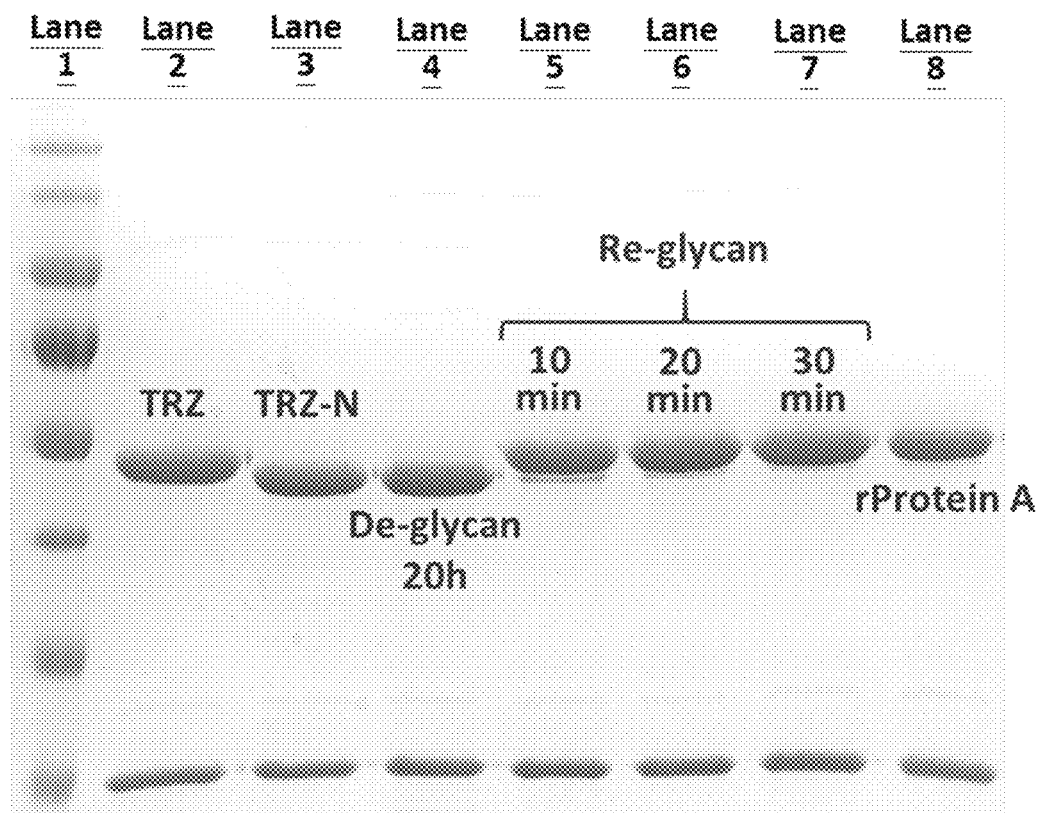
FIG. 8A shows SDS-PAGE analysis of the time course of glycan remodeling of trastuzumab (TRZ) by C-C401. The two native glycans are removed and each replaced by $Sia_2(\alpha 2\text{-}6)Gal_2GlcNAc_2Man_3GlcNAc_2$ (G2S2). Lane 2: Standard of TRZ. Lane 3: Standard of TRZ-N/N (TRZ containing two GlcNAc). Lane 4: Treating TRZ with C-C401 for 20 hours to obtain TRZ-N/N. Lanes 5-7: 95%, 98%, and 98% glycosylation of TRZ-N/N with SCT-oxazoline by C-C401 for 10, 20, and 30 minutes, respectively. Lane 8: Purified glyco-engineered TRZ (TRZ-G2S2/G2S2).

As shown in FIG. 8A, treatment of TRZ (lane 1) for 20 h with C-C401 removed all but the N-linked GlcNAc (lane 4) to yield TRZ-N/N (GlcNAc/GlcNac; lane 3). The amount of TRZ-N/N glycosylated after adjusting the temperature and adding Sia$_2$(α2-6)Gal$_2$GlcNAc$_2$Man$_3$GlcNAc-oxazoline was 95%, 98%, and 98% after 10 min., 20 min., and 30 min., respectively. See lanes 5, 6, and 7. Purified glyco-engineered TRZ-G2S2/G2S2 is shown in lane 8.

Figure 8B:
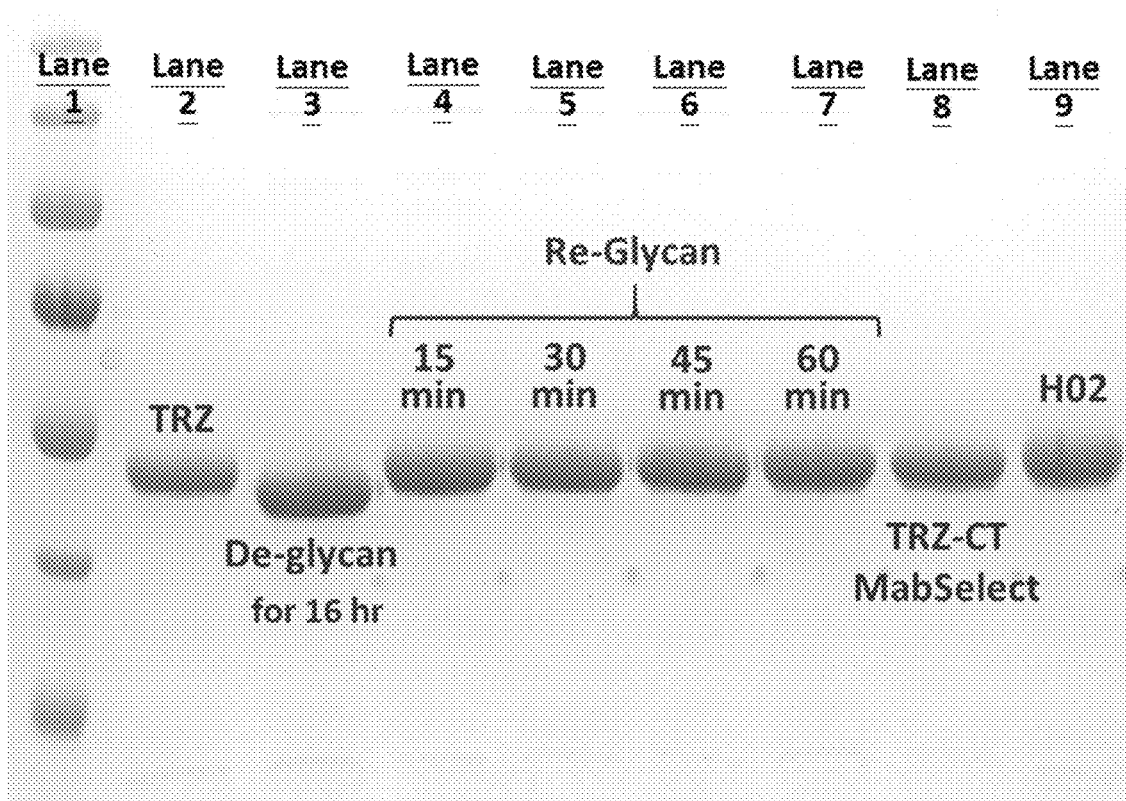
FIG. 8B shows SDS-PAGE analysis of glycan remodeling of TRZ by C-C401. The two native glycans are removed and each replaced by $Gal_2GlcNAc_2Man_3GlcNAc_2$ (G2). Lane 2: Standard of trastuzumab. Lane 3: Treating TRZ with C-C401 for 16 hours to obtain TRZ-N/N. Lanes 4-7: 98% glycosylation of TRZ-N/N with CT-oxazoline by C-C401 for 15, 30, 45, and 60 minutes. Lane 8: Purified glyco-engineered TRZ (TRZ-G2/G2). Lane 9: Standard of TRZ-G2S2/G2S2.

Turning to FIG. 8B, it shows that, after deglycosylation of TRZ for 16 h (lane 3), the amount of TRZ-N/N glycosylated after adjusting the temperature and adding Gal$_2$ GlcNAc$_2$Man$_3$GlcNAc-oxazoline was 98% at all time points. See lanes 4-7. Purified glyco-engineered TRZ-G2/G2 is shown in lane 8.

Example 9 Glyco-Engineering of Rituximab (RTX) by Fusion Protein, C-C401

Figure 9:
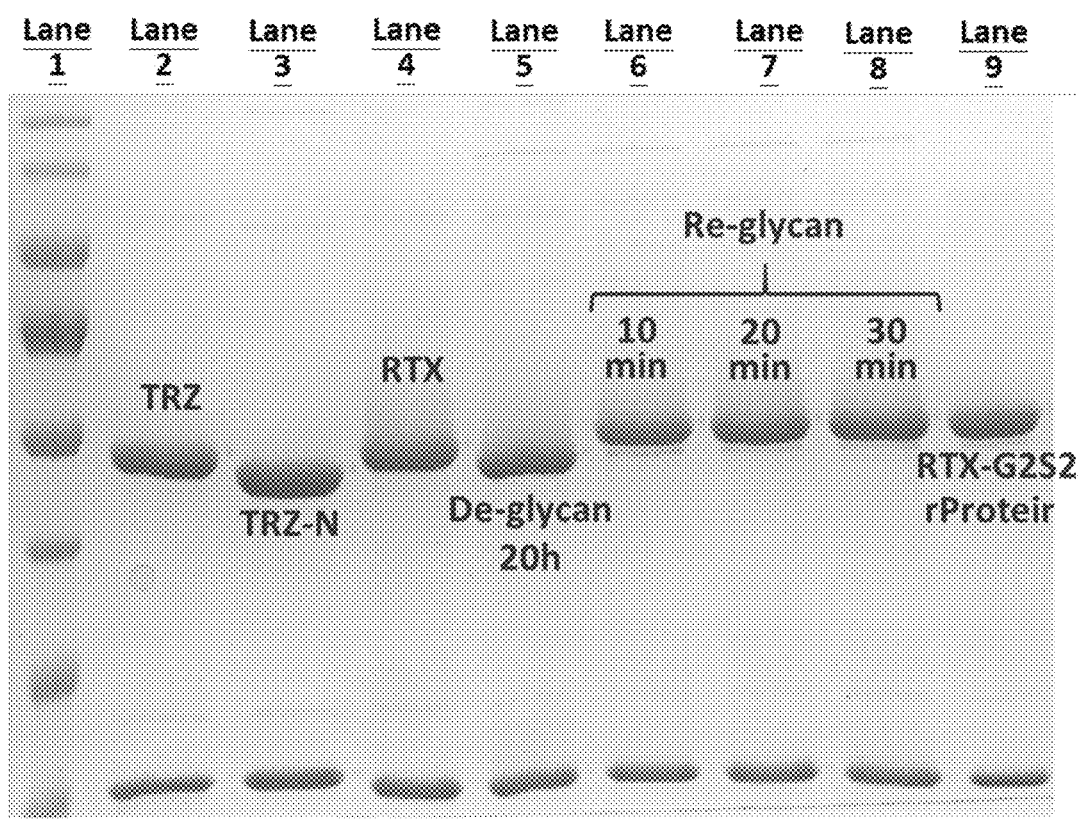
FIG. 9 shows SDS-PAGE analysis of glycan remodeling of rituximab (RTX) by C C401. Lane 2: Standard of trastuzumab. Lane 3: Standard of TRZ-N/N. Lane 4: Standard of rituximab. Lane 5: Treating RTX with C-C401 for 20 hours to obtain RTX-N/N. Lanes 6-8: 95%, 98%, and 98% glycosylation of RTX-N/N with SCT-oxazoline by C-C401. Lane 9: Purified glyco-engineered RTX (RTX-G2S2/G2S2).

Test antibody RTX was treated with fusion protein C-C401 in Tris-HCl. After adjusting the temperature to 30° C., Sia$_2$(α2-6)Gal$_2$GlcNAc$_2$ Man$_3$GlcNAc-oxazoline was added and the reaction incubated for 1 h. The glycan remodeled RTX was purified as described above in Example 2. The resulting RTX contained two G2S2 in the Fc region. Samples of the reactions were removed at different time intervals and analyzed by SDS-PAGE. The results are shown in FIG. 9.

Treatment of RTX (lane 4) for 20 h with C-C401 removed all but the N-linked GlcNAc to yield RTX-N/N (GlcNAc/GlcNac; lane 5). The amount of RTX-N/N glycosylated after adjusting the temperature and adding Sia$_2$(α2-6) Gal$_2$GlcNAc$_2$ Man$_3$GlcNAc-oxazoline was 95%, 98%, and 98% after 10 min., 20 min., and 30 min., respectively. See lanes 6, 7, and 8. Purified glyco-engineered RTX-G2S2/G2S2 is shown in lane 9.

Example 10 Glyco-Engineering of TRZ by Fusion Protein, C-C406

Figure 10:
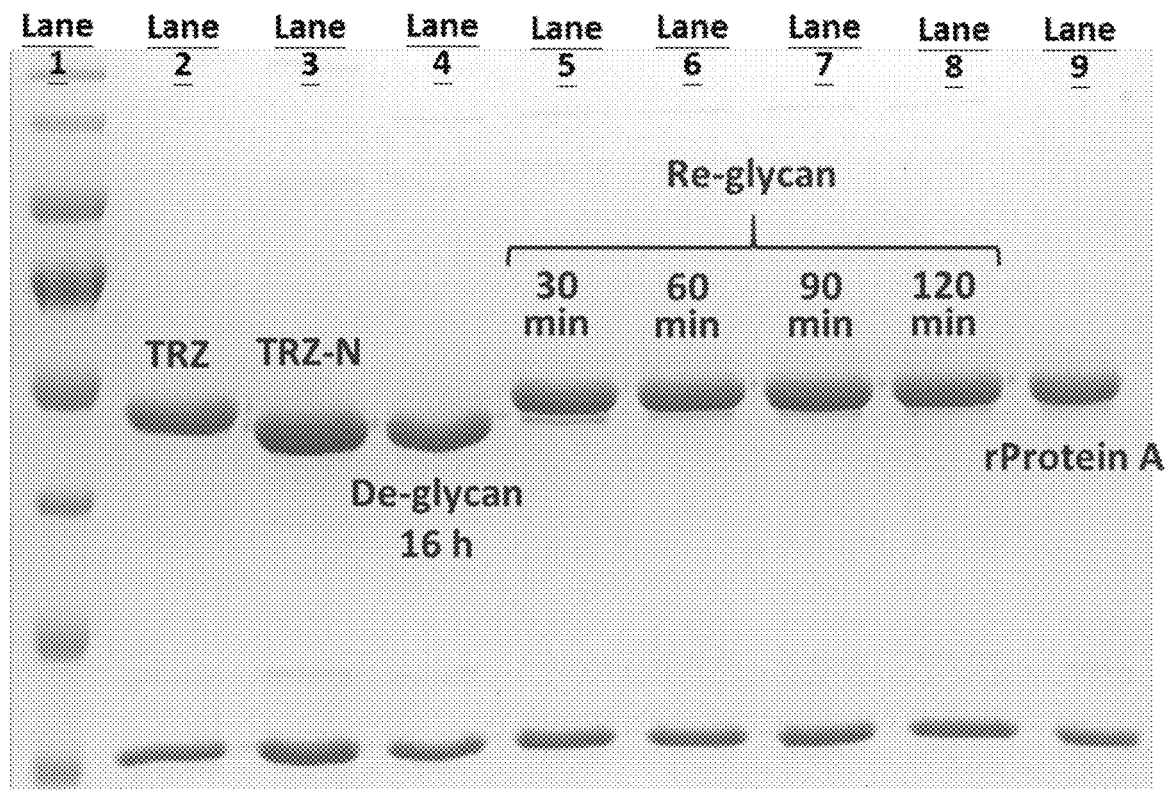
FIG. 10 shows SDS-PAGE analysis of glycan remodeling of TRZ by C-C406. Lane 2: Standard of trastuzumab. Lane 3: Standard of TRZ-N/N. Lane 4: Treating TRZ with C-C406 for 16 hours to obtain TRZ-N/N. Lanes 5-8: 90%, 95%, 98%, and 98% glycosylation of TRZ-N/N with SCT-oxazoline by C-C406 for 30, 60, 90, and 120 minutes respectively. Lane 9: Purified glyco-engineered TRZ (TRZ-G2S2/G2S2).

Test antibody TRZ, was treated with fusion protein C-C406, i.e., Alfc fused to the C-terminus of endoS2 D184S, in Tris-HCl (pH 7.0) at 37° C. for 16 h. After adjusting the temperature to 30° C., Sia$_2$(α2-6)Gal$_2$GlcNAc$_2$ Man$_3$GlcNAc-oxazoline was added and the reaction incubated for 1 h. The glycan remodeled TRZ was purified as set forth in Example 2, supra. The resulting TRZ contained two G2S2 in the Fc region. Samples of the reactions were removed at different time intervals and analyzed by SDS-PAGE. The results are shown in FIG. 10.

Treatment of TRZ (lane 1) for 16 h with C-C406 removed all but the N-linked GlcNAc to form TRZ-N/N (GlcNAc/GlcNac; lane 4). The amount of TRZ-N/N glycosylated after adjusting the temperature and adding Sia$_2$(α2-6) Gal$_2$GlcNAc$_2$Man$_3$GlcNAc-oxazoline was 90%, 95%, 98%, and 98% after 30 min., 60 min., 90 min., and 120 min., respectively. See lanes 5, 6, 7, and 8. Purified glyco-engineered TRZ-G2S2/G2S2 is shown in lane 9.

Example 11 Glyco-Engineering of TRZ by Fusion Protein, C-C407

Figure 11:
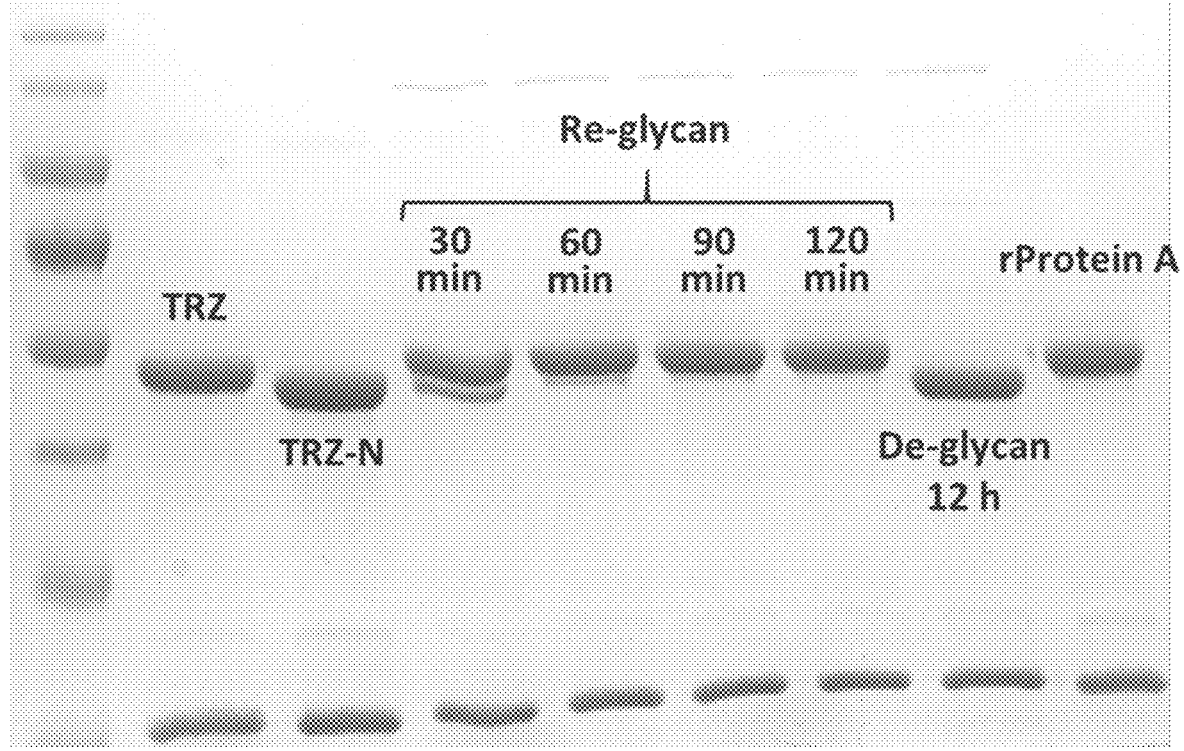
FIG. 11 shows SDS-PAGE analysis of glycan remodeling of TRZ by C-C407. Lane 2: Standard of trastuzumab. Lane 3: Standard of TRZ-N/N. Lanes 4-7: 80%, 95%, 98%, and 98% glycosylation of TRZ-N/N with SCT-oxazoline by C-C407 for 30, 60, 90, and 120 minutes, respectively. Lane 8: Treating TRZ with C-C407 for 12 hours to obtain TRZ-N/N. Lane 9: Purified glyco-engineered TRZ (TRZ-G2S2/G2S2).

Test antibody TRZ was treated with fusion protein C-C407, i.e., Alfc fused to the C-terminus of endoS2 D184V in Tris-HCl (pH 7.0) at 37° C. for 12 h. Sia$_2$(α2-6) Gal$_2$GlcNAc$_2$Man$_3$GlcNAc-oxazoline was added and the reaction incubated for 1 h. The glycan remodeled TRZ was purified as described above. The resulting TRZ contained two G2S2 in the Fc region. Samples of the reactions were removed at different time intervals and analyzed by SDS-PAGE. The results are shown in FIG. 11.

Treatment of TRZ (lane 1) for 12 h with C-C407 removed all but the N-linked GlcNAc to yield TRZ-N/N (GlcNAc/GlcNac; lane 8). The amount of TRZ-N/N glycosylated after adjusting the temperature and adding Sia$_2$(α2-6) Gal$_2$GlcNAc$_2$Man$_3$GlcNAc-oxazoline was 80%, 95%, 98%, and 98% after 30 min., 60 min., 90 min., and 120 min., respectively. See lanes 4, 5, 6, and 7. Purified glyco-engineered TRZ-G2S2/G2S2 is shown in lane 9.

Example 12 Glyco-Engineering of TRZ by Fusion Protein, C-C204

Figure 12:
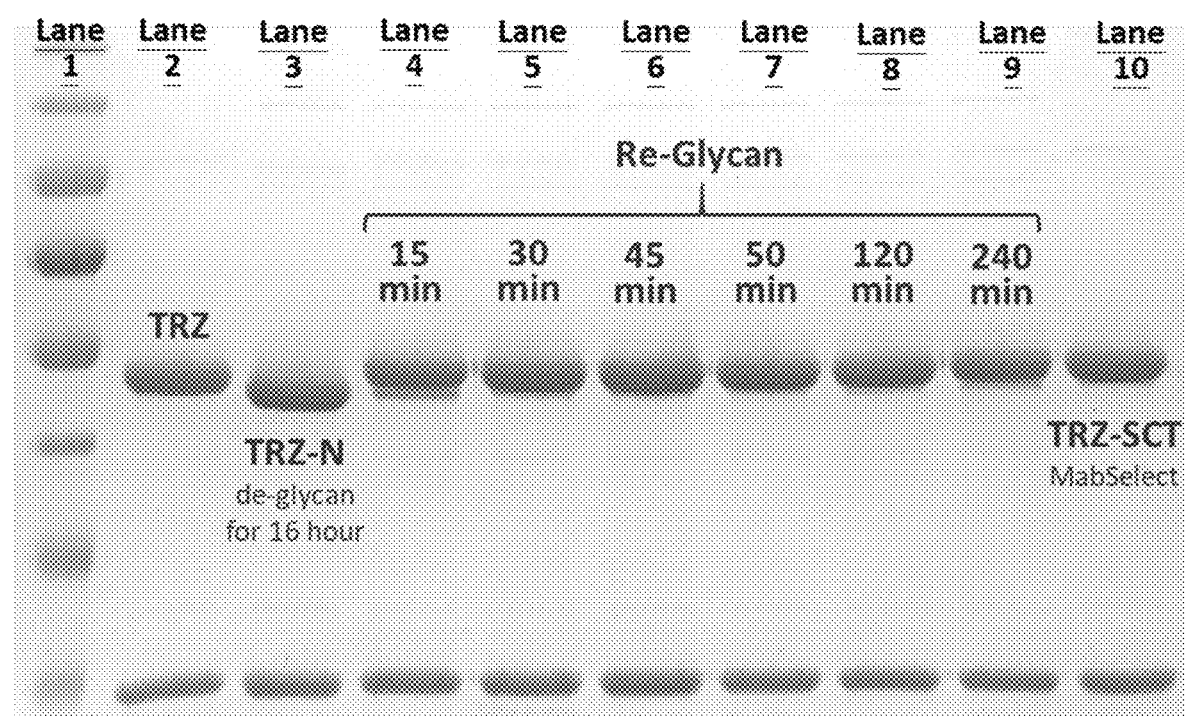
FIG. 12 shows SDS-PAGE analysis of glycan remodeling of TRZ by C-C204. Lane 2: Standard of trastuzumab. Lane 3: Treating TRZ with C-C204 for 16 hours to obtain TRZ-N/N. Lane 4-9: 85%, 97%, 98%, 98%, 97%, and 90% glycosylation of TRZ-N/N with SCT-oxazoline by C-C204 for 15, 30, 45, 60, 90, 120, and 240 minutes, respectively. Lane 10: Purified glyco-engineered TRZ (TRZ-G2S2/G2S2).

Test antibody TRZ was treated with fusion protein C-C204, i.e., Alfc fused to the C-terminus of endoS2 T138M in Tris-HCl (pH 7.0) at 37° C. for 16 h. $Sia_2(a2-6)Gal_2GlcNAc_2Man_3GlcNAc$-oxazoline was added and the reaction incubated for 4 h. The glycan remodeled TRZ (50 min) was purified as described above. The resulting TRZ contained two G2S2 in the Fc region. Samples of the reactions were removed at different time intervals and analyzed by SDS-PAGE. The results are shown in FIG. 12.

Treatment of TRZ (lane 1) for 16 h with C-C204 removed all but the N-linked GlcNAc to yield TRZ-N/N (GlcNAc/GlcNac; lane 3). The amount of TRZ-N/N glycosylated after adjusting the temperature and adding $Sia_2(a2-6)Gal_2GlcNAc_2Man_3GlcNAc$-oxazoline was 80%, 95%, 98%, 98%, 95% and 90% after 15 min, 30 min, 45 min, 50 min, 120 min, and 240 min, respectively. See lanes 4, 5, 6, 7, 8, and 9. Purified glyco-engineered TRZ-G2S2/G2S2 (50 min) is shown in lane 10.

While the present disclosure has been described in conjunction with the specific embodiments set forth above, many alternatives thereto and modifications and variations thereof will be apparent to those of ordinary skill in the art. All such alternatives, modifications and variations are regarded as falling within the scope of the present disclosure.

---

SEQUENCE LISTING (204 sequences)

SEQ ID NO: 1 - DNA, 2985 bp, Artificial Sequence
  SYNTHETIC FUSION PROTEN
atgggcagcagccatcatcatcatcatcacagcagcggcctggtgccgcgcggcagccatatgggtaccctgcagggatccaaagataagtcgtatgatctgattgatgagaaagatttcccagataaggctttgcgagaagctgtgatggcgcaggttggaaccagaaaaggtgatttggaacgtttcaatggcacattacgattggataatccagcgattcaaagtttagaaggtctaaataaatttaaaaaattagctcaattagacttgattggcttatctcgcattacaaagctcgaccgttctgttttacccgctaatatgaagccaggcaaagataccttggaaacagttcttgaaacctataaaaaggataacaaagaagaacctgctactatcccaccagtatctttgaaggtttctggtttaactggtctgaaagaattagatttgtcaggttttgaccgtgaaaccttggctggtcttgatgccgctactctaacgtctttagaaaaagttgatatttctggcaacaaacttgatttggctccaggaacagaaaatcgacaaatttttgatactatgctatcaactatcagcaatcatgttggaagcaatgaacaaacagtgaaatttgacaagcaaaaaccaactgggcattacccagatacctatgggaaaactagtctgcgcttaccagtggcaaatgaaaaagttgatttgcaaagccagcttttgtttgggactgtgacaaatcaaggaaccctaatcaatagcgaagcagactataaggcttaccaaaatcataaaattgctggacgtagctttgttgattcaaactatcattacaataactttaaagtttcttatgagaactataccgttaaagtaactgattccacattgggaaccactactgacaaaacgctagcaactgataaagaagagacctataaggttgacttctttagcccagcagataagacaaaagctgttcatactgctaaagtgattgttggtgacgaaaaaaccatgatggttaatttggcagaaggcgcaacagttattggaggaagtgctgatcctgtaaatgcaagaaaggtatttgatgggcaactgggcagtgagactgataatatctctttaggatgggattctaagcaaagtattatatttaaattgaaagaagatggattaataaagcattggcgtttcttcaatgattcagcccgaaatcctgagacaaccaataaacctattcaggaagcaagtctacaaatttttaatatcaaagattataatctagataatttgttggaaaatcccaataaatttgatgatgaaaaatattggattactgtagatacttacagtgcacaaggagagagagctactgcattcagtaatacattaaataatattactagtaaatattggcgagttgtctttgatactaaaggagatagatatagttcgccagtagtccctgaactccaaattttaggttatccgttacctaacgccgacactatcatgaaaacagtaactactgctaaagagttatctcaacaaaaagataagttttctcaaaagatgcttgatgagttaaaaataaaagagatggctttagaaacttctttgaacagtaagatttttgatgtaactgctattaatgctaatgctggagttttgaaagattgtattgagaaaaggcagctgctaaaaaaaggcggtgcacagcaaaagtatcaaccgacagaggctaacctgaaagcccggagtgaatttcaggacaataagtttggaatcttccttcattggggactctatgccatgctcgctaccggagagtggacgatgacaaacaataacctgaattataaagagtatgccaaactggccgggggattctatccttcgaagtttgatgcagacaaatgggtagcagccatcaaggcttccggagctaaatatatttgcttcactactcgtcatcacgagggattctcgatgttcgataccaagtactctgattataacattgtaaaagcgactcctttcaaacgtgatgtggtgaaggagctggccgatgcatgtgccaaacatggcatcaaacttcacttctattattcacatatagactggtatcgtgaagatgctcctcagggaagaaccggacgtagaaccggacgtcccaatccgaaaggagattggaagagctattatcagtttatgaataatcagttgacagagctgctgactaattatggtccgatcggcgctatctggtttgacggttggtgggatcaggacatcaatcccgatttcgattgggaacttcccgagcaatatgcacttattcatcgtttgcagccggcttgcctggtaggtaacaaccaccatcagacaccttttgccggagaagatattcaaatcttcgagcgtgatttgccgggagagaatactgcaggactttcgggacaaagcgtcagccatctgcctcttgaaacatgtgagacgatgaatggtatgtggggatacaagattacagatcagaattataaatcgactaaaactttgattcactatctggtgaaagctgccggtaaagatgcaaatctgttgatgaacatcggtccgcaacctgatggtgaacttccggaagtggccgttcagcgcttgaaggaagtgggagagtggatgtcgaaatatggtgaaactatttatggaaccagaggcggtctggttgctccgcatgattggggagtaacgactcaaaaaggcaataaactttatgtacacattcttaatttacaggataaggcactcttcttgcctattgtcgataagaaagtgaaaaaggcggtggtctttgctgacaaaacaccggtacgtttcacaaagaataaggaaggaattgtactggaacttgctaaagttccaacggatgtagactacgtggtagaacttacaattgactaa

SEQ ID NO: 2 - protein, 994 aa, Artificial Sequence
  SYNTHETIC FUSION PROTEN
MGSSHHHHHHSSGLVPRGSHMGTLQGSKDKSYDLIDEKDFPDKALREAVMAQVGTRKGDLERFNGTLRLDNPAIQSLEGLNKFKKLAQLDLIGLSRITKLDRSVLPANMKPGKDTLETVLETYKKDNKEEPATIPPVSLKVSGLTGLKELDLSGFDRETLAGLDAATLTSLEKVDISGNKLDLAPGTENRQIFDTMLSTISNHVGSNEQTVKFDKQKPTGHYPDTYGKTSLRLPVANEKVDLQSQLLFGTVTNQGTLINSEADYKAYQNHKIAGRSFVDSNYHYNNFKVSYENYTVKVTDSTLGTTTDKTLATDKEETYKVDFFSPADKTKAVHTAKVIVGDEKTMMVNLAEGATVIGGSADPVNARKVFDGQLGSETDNISLGWDSKQSIIFKLKEDGLIKHWRFFNDSARNPETTNKPIQEASLQIFNIKDYNLDNLLENPNKFDDEKYWITVDTYSAQGERATAFSNTLNNITSKYWRVVFDTKGDRYSSPVVPELQILGYPLPNADTIMKTVTTAKELSQQKDKFSQKMLDELKIKEMALETSLNSKIFDVTAINANAGVLKDCIEKRQLLKKGGAQQKYQPTEANLKARSEFQDNKFGIFLHWGLYAMLATGEWTMTNNNLNYKEYAKLAGGFYPSKFDADKWVAAIKASGAKYICFTTRHHEGFSMFDTKYSDYNIVKATPFKRDVVKELADACAKHGIKLHFYYSHIDWYREDAPQGRTGRRTGRPNPKGDWKSYYQFMNNQLTELLTNYGPIGAIWFDGWWDQDINPDFDWELPEQYALIHRLQPACLVGNNHHQTPFAGEDIQIFERDLPGENTAGLSGQSVSHLPLETCETMNGMWGYKITDQNYKSTKTLIHYLVKAAGKDANLLMNIGPQPDGELPEVAVQRLKEVGEWMSKYGETIYGTRGGLVAPHDWGVTTQKGNKLYVHILNLQDKALFLPIVDKKVKKAVVFADKTPVRFTKNKEGIVLELAKVPTDVDYVVELTID

SEQ ID NO: 3 - DNA, 2712 bp, Artificial Sequence
  SYNTHETIC FUSION PROTEN
atgggcagcagccatcatcatcatcatcacagcagcggcctggtgccgcgcggcagccatatgggtaccctgcagggatccaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggatggcggtgcacagcaaaagtatcaaccgacagaggctaacctgaaagcccggagtgaatttcaggacaataagtttggaatcttccttcattggggactctatgccatgctcgctaccggagagtggacgatgacaaacaataacctgaattataaagagtatgccaaactggccgggggattctatccttcgaagtttgatgcagacaaatgggtagcagccatcaaggcttccggagctaaatatatttgcttcactactcgtcatcacgagggattctcgatgttcgataccaagtactctgattataacattgtaaaagcgactcctttcaaacgtgatgtggtgaaggagctggccgatgcatgtgccaaacatggcatcaaacttcacttctattattcacatatagactggtatcgtgaagatgctcctcagggaagaaccggacgtagaaccggacgtcccaatccgaaaggagattggaagagctattatcagtttatgaataatcagttgacagagctgctgactaattatggtccgatcggcgctatctggtttgacggttggtgggatcaggacatcaatcccgatttcgattgggaacttcccgagcaatatgcacttattcatcgtttgcagccggcttgcctggtaggtaacaaccaccatcagacaccttttgccggagaagatattcaaatcttcgagcgtgatttgccgggagagaatactgcaggactttcgggacaaagcgtcagccatctgcctcttgaaacatgtgagacgatgaatggtatgtggggatacaagattacagatcagaattataaatcgactaaaactttgattcactatctggtgaaagctgccggtaaagatgcaaatctgttgatgaacatcggtccgcaacctgatggtgaacttccggaagtggccgttcagcgcttgaaggaagtgggagagtggatgtcgaaatatggtgaaactatttatggaaccagaggcggtctggttgctccgcatgattggggagtaacgactcaaaaaggcaataaactttatgtacacattcttaatttacaggataaggcactcttcttgcctattgtcgataagaaagtgaaaaaggcggtggtctttgctgacaaaacaccggtacgtttcacaaagaataaggaaggaattgtactggaacttgctaaagttccaacggatgtagactacgtggtagaacttacaattgactaa

SEQ ID NO: 4 - protein, 903 aa, Artificial Sequence
  SYNTHETIC FUSION PROTEN
MGSSHHHHHHSSGLVPRGSHMGTLQGSTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKDGGAQQKYQPTEANLKARSEFQDNKFGIFLHWGLYAMLATGEWTMTNNNLNYKEYAKLAGGFYPSKFDADKWVAAIKASGAKYICFTTRHHEGFSMFDTKYSDYNIVKATPFKRDVVKELADACAKHGIKLHFYYSHIDWYREDAPQGRTGRRTGRPNPKGDWKSYYQFMNNQLTELLTNYGPIGAIWFDGWWDQDINPDFDWELPEQYALIHRLQPACLVGNNHHQTPFAGEDIQIFERDLPGENTAGLSGQSVSHLPLETCETMNGMWGYKITDQNYKSTKTLIHYLVKAAGKDANLLMNIGPQPDGELPEVAVQRLKEVGEWMSKYGETIYGTRGGLVAPHDWGVTTQKGNKLYVHILNLQDKALFLPIVDKKVKKAVVFADKTPVRFTKNKEGIVLELAKVPTDVDYVVELTID

SEQ ID NO: 5 - DNA, 4260 bp, Artificial Sequence
  SYNTHETIC FUSION PROTEN
atgggcagcagccatcatcatcatcatcacagcagcggcctggtgccgcgcggcagccatatgacccaccatgattcactcaatactgtaaaagcggaggagaagactgttcaggttcagaaaggattaccttctatcgatagcttgcattatctgtcagagaatagcaaaaaagaatttaaagaagaactctcaaaagcggggcaagaatctcaaaaggtcaaagagatattagcaaaagctcagcaggcagataaacaagctcaagaacttgccaaaatgaaaattcctgagaaaataccgatgaaaccgttacatggttctctctacggtggttactttagaacttggcatgacaaaacatcagatccaacagaaaaagacaaagttaactcgatgggagagcttcctaaagaagtagatctagcctttattttccacgattggacaaaagattatagccttttttggaaagaattggccaccaaacatgtgccaaagttaaacaagcaagggacacgtgtcattcgtaccattccatggcgtttcctagctgggggtgataacagtggtattgcagaagataccagtaaatacccaaatacaccagagggaaataaagctttagccaaagctattgttgatgaatatgtttataaatacaaccttgatggcttagatgtggatgttgaacatgatagtattccaaaagttgacaaaaaagaagatacagcaggcgtagaacgctctattcaagtgtttgaagaaattgggaaattaattggaccaaaaggtgttgataaatcgcggttatttattatggatagcacctacatggctgataaaaacccattgattgagcgaggagctccttatattaatttattactggtacaggtctatggttcacaaggagagaaaggtggttgggagcctgtttctaatcgacctgaaaaaacaatggaagaacgatggcaaggttatagcaagtatattcgtcctgaacaatacatgattggtttttctttctatgaggaaaatgctcaagaagggaatctttggtatgatattaattctcgcaaggacgaggacaaagcaaatggaattaacactgacataactggaacgcgtgccgaacggtatgcaaggtggcaacctaagacaggtggggttaagggaggtatcttctcctacgctattgaccgagatggtgtagctcatcaacctaaaaaatatgctaaacagaaagagtttaaggacgcaactgataacatcttccactcagattatagtgtctccaaggcattaaagacagttatgctaaaagataagtcgtatgatctgattgatgagaaagatttcccagataaggctttgcgagaagctgtgatggcgcaggttggaaccagaaaaggtgatttggaacgtttcaatggcacattacgattggataatccagcgattcaaagtttagaaggtctaaataaatttaaaaaattagctcaattagacttgattggcttatctcgcattacaaagctcgaccgttctgttttacccgctaatatgaagccaggcaaagataccttggaaacagttcttgaaacctataaaaaggataacaaagaagaacctgctactatcccaccagtatctttgaaggtttctggtttaactggtctgaaagaattagatttgtcaggttttgaccgtgaaaccttggctggtcttgatgccgctactctaacgtctttagaaaaagttgatatttctggcaacaaacttgatttggctccaggaacagaaaatcgacaaatttttgatactatgctatcaactatcagcaatcatgttggaagcaatgaacaaacagtgaaatttgacaagcaaaaaccaactgggcattacccagatacctatgggaaaactagtctgcgcttaccagtggcaaatgaaaaagttgatttgcaaagccagcttttgtttgggactgtgacaaatcaaggaaccctaatcaatagcgaagcagactataaggcttaccaaaatcataaaattgctggacgtagctttgttgattcaaactatcattacaataactttaaagtttcttatgagaactataccgttaaagtaactgattccacattgggaaccactactgacaaaacgctagcaactgataaagaagagacctataaggttgacttctttagcccagcagataagacaaaagctgttcatactgctaaagtgattgttggtgacgaaaaaaccatgatggttaatttggcagaaggcgcaacagttattggaggaagtgctgatcctgtaaatgcaagaaaggtatttgatgggcaactgggcagtgagactgataatatctctttaggatgggattctaagcaaagtattatatttaaattgaaagaagatggattaataaagcattggcgtttcttcaatgattcagcccgaaatcctgagacaaccaataaacctattcaggaagcaagtctacaaatttttaatatcaaagattataatctagataatttgttggaaaatcccaataaatttgatgatgaaaaatattggattactgtagatacttacagtgcacaaggagagagagctactgcattcagtaatacattaaataatattactagtaaatattggcgagttgtctttgatactaaaggagatagatatagttcgccagtagtccctgaactccaaattttaggttatccgttacctaacgccgacactatcatgaaaacagtaactactgctaaagagttatctcaacaaaaagataagttttctcaaaagatgcttgatgagttaaaaataaaagagatggctttagaaacttctttgaacagtaagatttttgatgtaactgctattaatgctaatgctggagttttgaaagattgtattgagaaaaggcagctgctaaaaaaaggatccggtgctcagcaaaagtatcaaccgacagaggctaacctgaaagcccggagtgaatttcaggacaataagtttggaatcttccttcattggggactctatgccatgctcgctaccggagagtggacgatgacaaacaataacctgaattataaagagtatgccaaactggccgggggattctatccttcgaagtttgatgcagacaaatgggtagcagccatcaaggcttccggagctaaatatatttgcttcactactcgtcatcacgagggattctcgatgttcgataccaagtactctgattataacattgtaaaagcgactcctttcaaacgtgatgtggtgaaggagctggccgatgcatgtgccaaacatggcatcaaacttcacttctattattcacatatagactggtatcgtgaagatgctcctcagggaagaaccggacgtagaaccggacgtcccaatccgaaaggagattggaagagctattatcagtttatgaataatcagttgacagagctgctgactaattatggtccgatcggcgctatctggtttgacggttggtgggatcaggacatcaatcccgatttcgattgggaacttcccgagcaatatgcacttattcatcgtttgcagccggcttgcctggtaggtaacaaccaccatcagacaccttttgccggagaagatattcaaatcttcgagcgtgatttgccgggagagaatactgcaggactttcgggacaaagcgtcagccatctgcctcttgaaacatgtgagacgatgaatggtatgtggggatacaagattacagatcagaattataaatcgactaaaactttgattcactatctggtgaaagctgccggtaaagatgcaaatctgttgatgaacatcggtccgcaacctgatggtgaacttccggaagtggccgttcagcgcttgaaggaagtgggagagtggatgtcgaaatatggtgaaactatttatggaaccagaggcggtctggttgctccgcatgattggggagtaacgactcaaaaaggcaataaactttatgtacacattcttaatttacaggataaggcactcttcttgcctattgtcgataagaaagtgaaaaaggcggtggtctttgctgacaaaacaccggtacgtttcacaaagaataaggaaggaattgtactggaacttgctaaagttccaacggatgtagactacgtggtagaacttacaattgacggtacctggtctcatccgcagttcgagaaataa

SEQ ID NO: 6 - protein, 1419 aa, Artificial Sequence
  SYNTHETIC FUSION PROTEN
MGSSHHHHHHSSGLVPRGSHMTHHDSLNTVKAEEKTVQVQKGLPSIDSLHYLSENSKKEFKEELSKAGQESQKVKEILAKAQQADKQAQELAKMKIPEKIPMKPLHGSLYGGYFRTWHDKTSDPTEKDKVNSMGELPKEVDLAFIFHDWTKDYSLFWKELATKHVPKLNKQGTRVIRTIPWRFLAGGDNSGIAEDTSKYPNTPEGNKALAKAIVDEYVYKYNLDGLDVDVEHDSIPKVDKKEDTAGVERSIQVFEEIGKLIGPKGVDKSRLFIMDSTYMADKNPLIERGAPYINLLLVQVYGSQGEKGGWEPVSNRPEKTMEERWQGYSKYIRPEQYMIGFSFYEENAQEGNLWYDINSRKDEDKANGINTDITGTRAERYARWQPKTGGVKGGIFSYAIDRDGVAHQPKKYAKQKEFKDATDNIFHSDYSVSKALKTVMLKDKSYDLIDEKDFPDKALREAVMAQVGTRKGDLERFNGTLRLDNPAIQSLEGLNKFKKLAQLDLIGLSRITKLDRSVLPANMKPGKDTLETVLETYKKDNKEEPATIPPVSLKVSGLTGLKELDLSGFDRETLAGLDAATLTSLEKVDISGNKLDLAPGTENRQIFDTMLSTISNHVGSNEQTVKFDKQKPTGHYPDTYGKTSLRLPVANEKVDLQSQLLFGTVTNQGTLINSEADYKAYQNHKIAGRSFVDSNYHYNNFKVSYENYTVKVTDSTLGTTTDKTLATDKEETYKVDFFSPADKTKAVHTAKVIVGDEKTMMVNLAEGATVIGGSADPVNARKVFDGQLGSETDNISLGWDSKQSIIFKLKEDGLIKHWRFFNDSARNPETTNKPIQEASLQIFNIKDYNLDNLLENPNKFDDEKYWITVDTYSAQGERATAFSNTLNNITSKYWRVVFDTKGDRYSSPVVPELQILGYPLPNADTIMKTVTTAKELSQQKDKFSQKMLDELKIKEMALETSLNSKIFDVTAINANAGVLKDCIEKRQLLKKGSGAQQKYQPTEANLKARSEFQDNKFGIFLHWGLYAMLATGEWTMTNNNLNYKEYAKLAGGFYPSKFDADKWVAAIKASGAKYICFTTRHHEGFSMFDTKYSDYNIVKATPFKRDVVKELADACAKHGIKLHFYYSHIDWYREDAPQGRTGRRTGRPNPKGDWKSYYQFMNNQLTELLTNYGPIGAIWFDGWWDQDINPDFDWELPEQYALIHRLQPACLVGNNHHQTPFAGEDIQIFERDLPGENTAGLSGQSVSHLPLETCETMNGMWGYKITDQNYKSTKTLIHYLVKAAGKDANLLMNIGPQPDGELPEVAVQRLKEVGEWMSKYGETIYGTRGGLVAPHDWGVTTQKGNKLYVHILNLQDKALFLPIVDKKVKKAVVFADKTPVRFTKNKEGIVLELAKVPTDVDYVVELTIDGTWSHPQFEK

SEQ ID NO: 7 - DNA, 4260 bp, Artificial Sequence
  SYNTHETIC FUSION PROTEN
atgggcagcagccatcatcatcatcatcacagcagcggcctggtgccgcgcggcagccatatgacccaccatgattcactcaatactgtaaaagcggaggagaagactgttcaggttcagaaaggattaccttctatcgatagcttgcattatctgtcagagaatagcaaaaaagaatttaaagaagaactctcaaaagcggggcaagaatctcaaaaggtcaaagagatattagcaaaagctcagcaggcagataaacaagctcaagaacttgccaaaatgaaaattcctgagaaaataccgatgaaaccgttacatggttctctctacggtggttactttagaacttggcatgacaaaacatcagatccaacagaaaaagacaaagttaactcgatgggagagcttcctaaagaagtagatctagcctttattttccacgattggacaaaagattatagccttttttggaaagaattggccaccaaacatgtgccaaagttaaacaagcaagggacacgtgtcattcgtaccattccatggcgtttcctagctgggggtgataacagtggtattgcagaagataccagtaaatacccaaatacaccagagggaaataaagctttagccaaagctattgttgatgaatatgtttataaatacaaccttgatggcttagatgtgcaggttgaacatgatagtattccaaaagttgacaaaaaagaagatacagcaggcgtagaacgctctattcaagtgtttgaagaaattgggaaattaattggaccaaaaggtgttgataaatcgcggttatttattatggatagcacctacatggctgataaaaacccattgattgagcgaggagctccttatattaatttattactggtacaggtctatggttcacaaggagagaaaggtggttgggagcctgtttctaatcgacctgaaaaaacaatggaagaacgatggcaaggttatagcaagtatattcgtcctgaacaatacatgattggtttttctttctatgaggaaaatgctcaagaagggaatctttggtatgatattaattctcgcaaggacgaggacaaagcaaatggaattaacactgacataactggaacgcgtgccgaacggtatgcaaggtggcaacctaagacaggtggggttaagggaggtatcttctcctacgctattgaccgagatggtgtagctcatcaacctaaaaaatatgctaaacagaaagagtttaaggacgcaactgataacatcttccactcagattatagtgtctccaaggcattaaagacagttatgctaaaagataagtcgtatgatctgattgatgagaaagatttcccagataaggctttgcgagaagctgtgatggcgcaggttggaaccagaaaaggtgatttggaacgtttcaatggcacattacgattggataatccagcgattcaaagtttagaaggtctaaataaatttaaaaaattagctcaattagacttgattggcttatctcgcattacaaagctcgaccgttctgttttacccgctaatatgaagccaggcaaagataccttggaaacagttcttgaaacctataaaaaggataacaaagaagaacctgctactatcccaccagtatctttgaaggtttctggtttaactggtctgaaagaattagatttgtcaggttttgaccgtgaaaccttggctggtcttgatgccgctactctaacgtctttagaaaaagttgatatttctggcaacaaacttgatttggctccaggaacagaaaatcgacaaatttttgatactatgctatcaactatcagcaatcatgttggaagcaatgaacaaacagtgaaatttgacaagcaaaaaccaactgggcattacccagatacctatgggaaaactagtctgcgcttaccagtggcaaatgaaaaagttgatttgcaaagccagcttttgtttgggactgtgacaaatcaaggaaccctaatcaatagcgaagcagactataaggcttaccaaaatcataaaattgctggacgtagctttgttgattcaaactatcattacaataactttaaagtttcttatgagaactataccgttaaagtaactgattccacattgggaaccactactgacaaaacgctagcaactgataaagaagagacctataaggttgacttctttagcccagcagataagacaaaagctgttcatactgctaaagtgattgttggtgacgaaaaaaccatgatggttaatttggcagaaggcgcaacagttattggaggaagtgctgatcctgtaaatgcaagaaaggtatttgatgggcaactgggcagtgagactgataatatctctttaggatgggattctaagcaaagtattatatttaaattgaaagaagatggattaataaagcattggcgtttcttcaatgattcagcccgaaatcctgagacaaccaataaacctattcaggaagcaagtctacaaatttttaatatcaaagattataatctagataatttgttggaaaatcccaataaatttgatgatgaaaaatattggattactgtagatacttacagtgcacaaggagagagagctactgcattcagtaatacattaaataatattactagtaaatattggcgagttgtctttgatactaaaggagatagatatagttcgccagtagtccctgaactccaaattttaggttatccgttacctaacgccgacactatcatgaaaacagtaactactgctaaagagttatctcaacaaaaagataagttttctcaaaagatgcttgatgagttaaaaataaaagagatggctttagaaacttctttgaacagtaagatttttgatgtaactgctattaatgctaatgctggagttttgaaagattgtattgagaaaaggcagctgctaaaaaaaggatccggtgctcagcaaaagtatcaaccgacagaggctaacctgaaagcccggagtgaatttcaggacaataagtttggaatcttccttcattggggactctatgccatgctcgctaccggagagtggacgatgacaaacaataacctgaattataaagagtatgccaaactggccgggggattctatccttcgaagtttgatgcagacaaatgggtagcagccatcaaggcttccggagctaaatatatttgcttcactactcgtcatcacgagggattctcgatgttcgataccaagtactctgattataacattgtaaaagcgactcctttcaaacgtgatgtggtgaaggagctggccgatgcatgtgccaaacatggcatcaaacttcacttctattattcacatatagactggtatcgtgaagatgctcctcagggaagaaccggacgtagaaccggacgtcccaatccgaaaggagattggaagagctattatcagtttatgaataatcagttgacagagctgctgactaattatggtccgatcggcgctatctggtttgacggttggtgggatcaggacatcaatcccgatttcgattgggaacttcccgagcaatatgcacttattcatcgtttgcagccggcttgcctggtaggtaacaaccaccatcagacaccttttgccggagaagatattcaaatcttcgagcgtgatttgccgggagagaatactgcaggactttcgggacaaagcgtcagccatctgcctcttgaaacatgtgagacgatgaatggtatgtggggatacaagattacagatcagaattataaatcgactaaaactttgattcactatctggtgaaagctgccggtaaagatgcaaatctgttgatgaacatcggtccgcaacctgatggtgaacttccggaagtggccgttcagcgcttgaaggaagtgggagagtggatgtcgaaatatggtgaaactatttatggaaccagaggcggtctggttgctccgcatgattggggagtaacgactcaaaaaggcaataaactttatgtacacattcttaatttacaggataaggcactcttcttgcctattgtcgataagaaagtgaaaaaggcggtggtctttgctgacaaaacaccggtacgtttcacaaagaataaggaaggaattgtactggaacttgctaaagttccaacggatgtagactacgtggtagaacttacaattgacggtacctggtctcatccgcagttcgagaaataa

SEQ ID NO: 8 - protein, 1419 aa, Artificial Sequence
  SYNTHETIC FUSION PROTEN
MGSSHHHHHHSSGLVPRGSHMTHHDSLNTVKAEEKTVQVQKGLPSIDSLHYLSENSKKEFKEELSKAGQESQKVKEILAKAQQADKQAQELAKMKIPEKIPMKPLHGSLYGGYFRTWHDKTSDPTEKDKVNSMGELPKEVDLAFIFHDWTKDYSLFWKELATKHVPKLNKQGTRVIRTIPWRFLAGGDNSGIAEDTSKYPNTPEGNKALAKAIVDEYVYKYNLDGLDVQVEHDSIPKVDKKEDTAGVERSIQVFEEIGKLIGPKGVDKSRLFIMDSTYMADKNPLIERGAPYINLLLVQVYGSQGEKGGWEPVSNRPEKTMEERWQGYSKYIRPEQYMIGFSFYEENAQEGNLWYDINSRKDEDKANGINTDITGTRAERYARWQPKTGGVKGGIFSYAIDRDGVAHQPKKYAKQKEFKDATDNIFHSDYSVSKALKTVMLKDKSYDLIDEKDFPDKALREAVMAQVGTRKGDLERFNGTLRLDNPAIQSLEGLNKFKKLAQLDLIGLSRITKLDRSVLPANMKPGKDTLETVLETYKKDNKEEPATIPPVSLKVSGLTGLKELDLSGFDRETLAGLDAATLTSLEKVDISGNKLDLAPGTENRQIFDTMLSTISNHVGSNEQTVKFDKQKPTGHYPDTYGKTSLRLPVANEKVDLQSQLLFGTVTNQGTLINSEADYKAYQNHKIAGRSFVDSNYHYNNFKVSYENYTVKVTDSTLGTTTDKTLATDKEETYKVDFFSPADKTKAVHTAKVIVGDEKTMMVNLAEGATVIGGSADPVNARKVFDGQLGSETDNISLGWDSKQSIIFKLKEDGLIKHWRFFNDSARNPETTNKPIQEASLQIFNIKDYNLDNLLENPNKFDDEKYWITVDTYSAQGERATAFSNTLNNITSKYWRVVFDTKGDRYSSPVVPELQILGYPLPNADTIMKTVTTAKELSQQKDKFSQKMLDELKIKEMALETSLNSKIFDVTAINANAGVLKDCIEKRQLLKKGSGAQQKYQPTEANLKARSEFQDNKFGIFLHWGLYAMLATGEWTMTNNNLNYKEYAKLAGGFYPSKFDADKWVAAIKASGAKYICFTTRHHEGFSMFDTKYSDYNIVKATPFKRDVVKELADACAKHGIKLHFYYSHIDWYREDAPQGRTGRRTGRPNPKGDWKSYYQFMNNQLTELLTNYGPIGAIWFDGWWDQDINPDFDWELPEQYALIHRLQPACLVGNNHHQTPFAGEDIQIFERDLPGENTAGLSGQSVSHLPLETCETMNGMWGYKITDQNYKSTKTLIHYLVKAAGKDANLLMNIGPQPDGELPEVAVQRLKEVGEWMSKYGETIYGTRGGLVAPHDWGVTTQKGNKLYVHILNLQDKALFLPIVDKKVKKAVVFADKTPVRFTKNKEGIVLELAKVPTDVDYVVELTIDGTWSHPQFEK

SEQ ID NO: 9 - DNA, 3927 bp, Artificial Sequence
  SYNTHETIC FUSION PROTEN
atgggcagcagccatcatcatcatcatcacagcagcggcctggtgccgcgcggcagccatatgggatccatggataaacatttgttggtaaaaagaacactagggtgtgtttgtgctgcaacgttgatgggagctgccttagcgacccaccatgattcactcaatactgtaaaagcggaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcagacaattggtgttaacgaattaaatggacgtacaggtttatctaaagattatcctgatactcctgaggggaacaaagctttagcagcagccattgtcaaggcatttgtaactgatcgtggtgtcgatggactagatattgatattgagcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggatgaattcatgggcagcagccatcatcaccatcaccatgagctccccgggccgcgggaaaacctgtattttcagggagcgatcgctcagcaaaagtatcaaccgacagaggctaacctgaaagcccggagtgaatttcaggacaataagtttggaatcttccttcattggggactctatgccatgctcgctaccggagagtggacgatgacaaacaataacctgaattataaagagtatgccaaactggccgggggattctatccttcgaagtttgatgcagacaaatgggtagcagccatcaaggcttccggagctaaatatatttgcttcactactcgtcatcacgagggattctcgatgttcgataccaagtactctgattataacattgtaaaagcgactcctttcaaacgtgatgtggtgaaggagctggccgatgcatgtgccaaacatggcatcaaacttcacttctattattcacatatagactggtatcgtgaagatgctcctcagggaagaaccggacgtagaaccggacgtcccaatccgaaaggagattggaagagctattatcagtttatgaataatcagttgacagagctgctgactaattatggtccgatcggcgctatctggtttgacggttggtgggatcaggacatcaatcccgatttcgattgggaacttcccgagcaatatgcacttattcatcgtttgcagccggcttgcctggtaggtaacaaccaccatcagacaccttttgccggagaagatattcaaatcttcgagcgtgatttgccgggagagaatactgcaggactttcgggacaaagcgtcagccatctgcctcttgaaacatgtgagacgatgaatggtatgtggggatacaagattacagatcagaattataaatcgactaaaactttgattcactatctggtgaaagctgccggtaaagatgcaaatctgttgatgaacatcggtccgcaacctgatggtgaacttccggaagtggccgttcagcgcttgaaggaagtgggagagtggatgtcgaaatatggtgaaactatttatggaaccagaggcggtctggttgctccgcatgattggggagtaacgactcaaaaaggcaataaactttatgtacacattcttaatttacaggataaggcactcttcttgcctattgtcgataagaaagtgaaaaaggcggtggtctttgctgacaaaacaccggtacgtttcacaaagaataaggaaggaattgtactggaacttgctaaagttccaacggatgtagactacgtggtagaacttacaattgactaa

SEQ ID NO: 10 - protein, 1308 aa, Artificial Sequence
  SYNTHETIC FUSION PROTEN
MGSSHHHHHHSSGLVPRGSHMGSMDKHLLVKRTLGCVCAATLMGAALATHHDSLNTVKAEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQTIGVNELNGRTGLSKDYPDTPEGNKALAAAIVKAFVTDRGVDGLDIDIEHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKDEFMGSSHHHHHHELPGPRENLYFQGAIAQQKYQPTEANLKARSEFQDNKFGIFLHWGLYAMLATGEWTMTNNNLNYKEYAKLAGGFYPSKFDADKWVAAIKASGAKYICFTTRHHEGFSMFDTKYSDYNIVKATPFKRDVVKELADACAKHGIKLHFYYSHIDWYREDAPQGRTGRRTGRPNPKGDWKSYYQFMNNQLTELLTNYGPIGAIWFDGWWDQDINPDFDWELPEQYALIHRLQPACLVGNNHHQTPFAGEDIQIFERDLPGENTAGLSGQSVSHLPLETCETMNGMWGYKITDQNYKSTKTLIHYLVKAAGKDANLLMNIGPQPDGELPEVAVQRLKEVGEWMSKYGETIYGTRGGLVAPHDWGVTTQKGNKLYVHILNLQDKALFLPIVDKKVKKAVVFADKTPVRFTKNKEGIVLELAKVPTDVDYVVELTID

SEQ ID NO: 11 - DNA, 3927 bp, Artificial Sequence
  SYNTHETIC FUSION PROTEN
atgggcagcagccatcatcatcatcatcacagcagcggcctggtgccgcgcggcagccatatgggatccatggataaacatttgttggtaaaaagaacactagggtgtgtttgtgctgcaacgttgatgggagctgccttagcgacccaccatgattcactcaatactgtaaaagcggaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcaggaaattggtgttaacgaattaaatggacgtacaggtttatctaaagattatcctgatactcctgaggggaacaaagctttagcagcagccattgtcaaggcatttgtaactgatcgtggtgtcgatggactagatattgatattgagcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggatgaattcatgggcagcagccatcatcaccatcaccatgagctccccgggccgcgggaaaacctgtattttcagggagcgatcgctcagcaaaagtatcaaccgacagaggctaacctgaaagcccggagtgaatttcaggacaataagtttggaatcttccttcattggggactctatgccatgctcgctaccggagagtggacgatgacaaacaataacctgaattataaagagtatgccaaactggccgggggattctatccttcgaagtttgatgcagacaaatgggtagcagccatcaaggcttccggagctaaatatatttgcttcactactcgtcatcacgagggattctcgatgttcgataccaagtactctgattataacattgtaaaagcgactcctttcaaacgtgatgtggtgaaggagctggccgatgcatgtgccaaacatggcatcaaacttcacttctattattcacatatagactggtatcgtgaagatgctcctcagggaagaaccggacgtagaaccggacgtcccaatccgaaaggagattggaagagctattatcagtttatgaataatcagttgacagagctgctgactaattatggtccgatcggcgctatctggtttgacggttggtgggatcaggacatcaatcccgatttcgattgggaacttcccgagcaatatgcacttattcatcgtttgcagccggcttgcctggtaggtaacaaccaccatcagacaccttttgccggagaagatattcaaatcttcgagcgtgatttgccgggagagaatactgcaggactttcgggacaaagcgtcagccatctgcctcttgaaacatgtgagacgatgaatggtatgtggggatacaagattacagatcagaattataaatcgactaaaactttgattcactatctggtgaaagctgccggtaaagatgcaaatctgttgatgaacatcggtccgcaacctgatggtgaacttccggaagtggccgttcagcgcttgaaggaagtgggagagtggatgtcgaaatatggtgaaactatttatggaaccagaggcggtctggttgctccgcatgattggggagtaacgactcaaaaaggcaataaactttatgtacacattcttaatttacaggataaggcactcttcttgcctattgtcgataagaaagtgaaaaaggcggtggtctttgctgacaaaacaccggtacgtttcacaaagaataaggaaggaattgtactggaacttgctaaagttccaacggatgtagactacgtggtagaacttacaattgactaa

SEQ ID NO: 12 - protein, 1308 aa, Artificial Sequence
  SYNTHETIC FUSION PROTEN
MGSSHHHHHHSSGLVPRGSHMGSMDKHLLVKRTLGCVCAATLMGAALATHHDSLNTVKAEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQEIGVNELNGRTGLSKDYPDTPEGNKALAAAIVKAFVTDRGVDGLDIDIEHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKDEFMGSSHHHHHHELPGPRENLYFQGAIAQQKYQPTEANLKARSEFQDNKFGIFLHWGLYAMLATGEWTMTNNNLNYKEYAKLAGGFYPSKFDADKWVAAIKASGAKYICFTTRHHEGFSMFDTKYSDYNIVKATPFKRDVVKELADACAKHGIKLHFYYSHIDWYREDAPQGRTGRRTGRPNPKGDWKSYYQFMNNQLTELLTNYGPIGAIWFDGWWDQDINPDFDWELPEQYALIHRLQPACLVGNNHHQTPFAGEDIQIFERDLPGENTAGLSGQSVSHLPLETCETMNGMWGYKITDQNYKSTKTLIHYLVKAAGKDANLLMNIGPQPDGELPEVAVQRLKEVGEWMSKYGETIYGTRGGLVAPHDWGVTTQKGNKLYVHILNLQDKALFLPIVDKKVKKAVVFADKTPVRFTKNKEGIVLELAKVPTDVDYVVELTID

SEQ ID NO: 13 - DNA, 3927 bp, Artificial Sequence
  SYNTHETIC FUSION PROTEN
atgggcagcagccatcatcatcatcatcacagcagcggcctggtgccgcgcggcagccatatgggatccatggataaacatttgttggtaaaaagaacactagggtgtgtttgtgctgcaacgttgatgggagctgccttagcgacccaccatgattcactcaatactgtaaaagcggaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcagatgattggtgttaacgaattaaatggacgtacaggtttatctaaagattatcctgatactcctgaggggaacaaagctttagcagcagccattgtcaaggcatttgtaactgatcgtggtgtcgatggactagatattgatattgagcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggatgaattcatgggcagcagccatcatcaccatcaccatgagctccccgggccgcgggaaaacctgtattttcagggagcgatcgctcagcaaaagtatcaaccgacagaggctaacctgaaagcccggagtgaatttcaggacaataagtttggaatcttccttcattggggactctatgccatgctcgctaccggagagtggacgatgacaaacaataacctgaattataaagagtatgccaaactggccgggggattctatccttcgaagtttgatgcagacaaatgggtagcagccatcaaggcttccggagctaaatatatttgcttcactactcgtcatcacgagggattctcgatgttcgataccaagtactctgattataacattgtaaaagcgactcctttcaaacgtgatgtggtgaaggagctggccgatgcatgtgccaaacatggcatcaaacttcacttctattattcacatatagactggtatcgtgaagatgctcctcagggaagaaccggacgtagaaccggacgtcccaatccgaaaggagattggaagagctattatcagtttatgaataatcagttgacagagctgctgactaattatggtccgatcggcgctatctggtttgacggttggtgggatcaggacatcaatcccgatttcgattgggaacttcccgagcaatatgcacttattcatcgtttgcagccggcttgcctggtaggtaacaaccaccatcagacaccttttgccggagaagatattcaaatcttcgagcgtgatttgccgggagagaatactgcaggactttcgggacaaagcgtcagccatctgcctcttgaaacatgtgagacgatgaatggtatgtggggatacaagattacagatcagaattataaatcgactaaaactttgattcactatctggtgaaagctgccggtaaagatgcaaatctgttgatgaacatcggtccgcaacctgatggtgaacttccggaagtggccgttcagcgcttgaaggaagtgggagagtggatgtcgaaatatggtgaaactatttatggaaccagaggcggtctggttgctccgcatgattggggagtaacgactcaaaaaggcaataaactttatgtacacattcttaatttacaggataaggcactcttcttgcctattgtcgataagaaagtgaaaaaggcggtggtctttgctgacaaaacaccggtacgtttcacaaagaataaggaaggaattgtactggaacttgctaaagttccaacggatgtagactacgtggtagaacttacaattgactaa

SEQ ID NO: 14 - protein, 1308 aa, Artificial Sequence
  SYNTHETIC FUSION PROTEN
MGSSHHHHHHSSGLVPRGSHMGSMDKHLLVKRTLGCVCAATLMGAALATHHDSLNTVKAEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQMIGVNELNGRTGLSKDYPDTPEGNKALAAAIVKAFVTDRGVDGLDIDIEHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKDEFMGSSHHHHHHELPGPRENLYFQGAIAQQKYQPTEANLKARSEFQDNKFGIFLHWGLYAMLATGEWTMTNNNLNYKEYAKLAGGFYPSKFDADKWVAAIKASGAKYICFTTRHHEGFSMFDTKYSDYNIVKATPFKRDVVKELADACAKHGIKLHFYYSHIDWYREDAPQGRTGRRTGRPNPKGDWKSYYQFMNNQLTELLTNYGPIGAIWFDGWWDQDINPDFDWELPEQYALIHRLQPACLVGNNHHQTPFAGEDIQIFERDLPGENTAGLSGQSVSHLPLETCETMNGMWGYKITDQNYKSTKTLIHYLVKAAGKDANLLMNIGPQPDGELPEVAVQRLKEVGEWMSKYGETIYGTRGGLVAPHDWGVTTQKGNKLYVHILNLQDKALFLPIVDKKVKKAVVFADKTPVRFTKNKEGIVLELAKVPTDVDYVVELTID

SEQ ID NO: 15 - DNA, 3927 bp, Artificial Sequence
  SYNTHETIC FUSION PROTEN
atgggcagcagccatcatcatcatcatcacagcagcggcctggtgccgcgcggcagccatatgggatccatggataaacatttgttggtaaaaagaacactagggtgtgtttgtgctgcaacgttgatgggagctgccttagcgacccaccatgattcactcaatactgtaaaagcggaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcagacaattggtgttaacgaattaaatggacgtacaggtttatctaaagattatcctgatactcctgaggggaacaaagctttagcagcagccattgtcaaggcatttgtaactgatcgtggtgtcgatggactagatattatgattgagcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggatgaattcatgggcagcagccatcatcaccatcaccatgagctccccgggccgcgggaaaacctgtattttcagggagcgatcgctcagcaaaagtatcaaccgacagaggctaacctgaaagcccggagtgaatttcaggacaataagtttggaatcttccttcattggggactctatgccatgctcgctaccggagagtggacgatgacaaacaataacctgaattataaagagtatgccaaactggccgggggattctatccttcgaagtttgatgcagacaaatgggtagcagccatcaaggcttccggagctaaatatatttgcttcactactcgtcatcacgagggattctcgatgttcgataccaagtactctgattataacattgtaaaagcgactcctttcaaacgtgatgtggtgaaggagctggccgatgcatgtgccaaacatggcatcaaacttcacttctattattcacatatagactggtatcgtgaagatgctcctcagggaagaaccggacgtagaaccggacgtcccaatccgaaaggagattggaagagctattatcagtttatgaataatcagttgacagagctgctgactaattatggtccgatcggcgctatctggtttgacggttggtgggatcaggacatcaatcccgatttcgattgggaacttcccgagcaatatgcacttattcatcgtttgcagccggcttgcctggtaggtaacaaccaccatcagacaccttttgccggagaagatattcaaatcttcgagcgtgatttgccgggagagaatactgcaggactttcgggacaaagcgtcagccatctgcctcttgaaacatgtgagacgatgaatggtatgtggggatacaagattacagatcagaattataaatcgactaaaactttgattcactatctggtgaaagctgccggtaaagatgcaaatctgttgatgaacatcggtccgcaacctgatggtgaacttccggaagtggccgttcagcgcttgaaggaagtgggagagtggatgtcgaaatatggtgaaactatttatggaaccagaggcggtctggttgctccgcatgattggggagtaacgactcaaaaaggcaataaactttatgtacacattcttaatttacaggataaggcactcttcttgcctattgtcgataagaaagtgaaaaaggcggtggtctttgctgacaaaacaccggtacgtttcacaaagaataaggaaggaattgtactggaacttgctaaagttccaacggatgtagactacgtggtagaacttacaattgactaa

SEQ ID NO: 16 - protein, 1308 aa, Artificial Sequence
  SYNTHETIC FUSION PROTEN
MGSSHHHHHHSSGLVPRGSHMGSMDKHLLVKRTLGCVCAATLMGAALATHHDSLNTVKAEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQTIGVNELNGRTGLSKDYPDTPEGNKALAAAIVKAFVTDRGVDGLDIMIEHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKDEFMGSSHHHHHHELPGPRENLYFQGAIAQQKYQPTEANLKARSEFQDNKFGIFLHWGLYAMLATGEWTMTNNNLNYKEYAKLAGGFYPSKFDADKWVAAIKASGAKYICFTTRHHEGFSMFDTKYSDYNIVKATPFKRDVVKELADACAKHGIKLHFYYSHIDWYREDAPQGRTGRRTGRPNPKGDWKSYYQFMNNQLTELLTNYGPIGAIWFDGWWDQDINPDFDWELPEQYALIHRLQPACLVGNNHHQTPFAGEDIQIFERDLPGENTAGLSGQSVSHLPLETCETMNGMWGYKITDQNYKSTKTLIHYLVKAAGKDANLLMNIGPQPDGELPEVAVQRLKEVGEWMSKYGETIYGTRGGLVAPHDWGVTTQKGNKLYVHILNLQDKALFLPIVDKKVKKAVVFADKTPVRFTKNKEGIVLELAKVPTDVDYVVELTID

SEQ ID NO: 17 - DNA, 2964 bp, Artificial Sequence
  SYNTHETIC FUSION PROTEN
atgggcagcagccatcatcatcatcatcacagcagcggcctggtgccgcgcggcagccatatgcagcaaaagtatcaaccgacagaggctaacctgaaagcccggagtgaatttcaggacaataagtttggaatcttccttcattggggactctatgccatgctcgctaccggagagtggacgatgacaaacaataacctgaattataaagagtatgccaaactggccgggggattctatccttcgaagtttgatgcagacaaatgggtagcagccatcaaggcttccggagctaaatatatttgcttcactactcgtcatcacgagggattctcgatgttcgataccaagtactctgattataacattgtaaaagcgactcctttcaaacgtgatgtggtgaaggagctggccgatgcatgtgccaaacatggcatcaaacttcacttctattattcacatatagactggtatcgtgaagatgctcctcagggaagaaccggacgtagaaccggacgtcccaatccgaaaggagattggaagagctattatcagtttatgaataatcagttgacagagctgctgactaattatggtccgatcggcgctatctggtttgacggttggtgggatcaggacatcaatcccgatttcgattgggaacttcccgagcaatatgcacttattcatcgtttgcagccggcttgcctggtaggtaacaaccaccatcagacaccttttgccggagaagatattcaaatcttcgagcgtgatttgccgggagagaatactgcaggactttcgggacaaagcgtcagccatctgcctcttgaaacatgtgagacgatgaatggtatgtggggatacaagattacagatcagaattataaatcgactaaaactttgattcactatctggtgaaagctgccggtaaagatgcaaatctgttgatgaacatcggtccgcaacctgatggtgaacttccggaagtggccgttcagcgcttgaaggaagtgggagagtggatgtcgaaatatggtgaaactatttatggaaccagaggcggtctggttgctccgcatgattggggagtaacgactcaaaaaggcaataaactttatgtacacattcttaatttacaggataaggcactcttcttgcctattgtcgataagaaagtgaaaaaggcggtggtctttgctgacaaaacaccggtacgtttcacaaagaataaggaaggaattgtactggaacttgctaaagttccaacggatgtagactacgtggtagaacttacaattgacggatccaaagataagtcgtatgatctgattgatgagaaagatttcccagataaggctttgcgagaagctgtgatggcgcaggttggaaccagaaaaggtgatttggaacgtttcaatggcacattacgattggataatccagcgattcaaagtttagaaggtctaaataaatttaaaaaattagctcaattagacttgattggcttatctcgcattacaaagctcgaccgttctgttttacccgctaatatgaagccaggcaaagataccttggaaacagttcttgaaacctataaaaaggataacaaagaagaacctgctactatcccaccagtatctttgaaggtttctggtttaactggtctgaaagaattagatttgtcaggttttgaccgtgaaaccttggctggtcttgatgccgctactctaacgtctttagaaaaagttgatatttctggcaacaaacttgatttggctccaggaacagaaaatcgacaaatttttgatactatgctatcaactatcagcaatcatgttggaagcaatgaacaaacagtgaaatttgacaagcaaaaaccaactgggcattacccagatacctatgggaaaactagtctgcgcttaccagtggcaaatgaaaaagttgatttgcaaagccagcttttgtttgggactgtgacaaatcaaggaaccctaatcaatagcgaagcagactataaggcttaccaaaatcataaaattgctggacgtagctttgttgattcaaactatcattacaataactttaaagtttcttatgagaactataccgttaaagtaactgattccacattgggaaccactactgacaaaacgctagcaactgataaagaagagacctataaggttgacttctttagcccagcagataagacaaaagctgttcatactgctaaagtgattgttggtgacgaaaaaaccatgatggttaatttggcagaaggcgcaacagttattggaggaagtgctgatcctgtaaatgcaagaaaggtatttgatgggcaactgggcagtgagactgataatatctctttaggatgggattctaagcaaagtattatatttaaattgaaagaagatggattaataaagcattggcgtttcttcaatgattcagcccgaaatcctgagacaaccaataaacctattcaggaagcaagtctacaaatttttaatatcaaagattataatctagataatttgttggaaaatcccaataaatttgatgatgaaaaatattggattactgtagatacttacagtgcacaaggagagagagctactgcattcagtaatacattaaataatattactagtaaatattggcgagttgtctttgatactaaaggagatagatatagttcgccagtagtccctgaactccaaattttaggttatccgttacctaacgccgacactatcatgaaaacagtaactactgctaaagagttatctcaacaaaaagataagttttctcaaaagatgcttgatgagttaaaaataaaagagatggctttagaaacttctttgaacagtaagatttttgatgtaactgctattaatgctaatgctggagttttgaaagattgtattgagaaaaggcagctgctaaaaaaataa

SEQ ID NO: 18 - protein, 987 aa, Artificial Sequence
  SYNTHETIC FUSION PROTEN
MGSSHHHHHHSSGLVPRGSHMQQKYQPTEANLKARSEFQDNKFGIFLHWGLYAMLATGEWTMTNNNLNYKEYAKLAGGFYPSKFDADKWVAAIKASGAKYICFTTRHHEGFSMFDTKYSDYNIVKATPFKRDVVKELADACAKHGIKLHFYYSHIDWYREDAPQGRTGRRTGRPNPKGDWKSYYQFMNNQLTELLTNYGPIGAIWFDGWWDQDINPDFDWELPEQYALIHRLQPACLVGNNHHQTPFAGEDIQIFERDLPGENTAGLSGQSVSHLPLETCETMNGMWGYKITDQNYKSTKTLIHYLVKAAGKDANLLMNIGPQPDGELPEVAVQRLKEVGEWMSKYGETIYGTRGGLVAPHDWGVTTQKGNKLYVHILNLQDKALFLPIVDKKVKKAVVFADKTPVRFTKNKEGIVLELAKVPTDVDYVVELTIDGSKDKSYDLIDEKDFPDKALREAVMAQVGTRKGDLERFNGTLRLDNPAIQSLEGLNKFKKLAQLDLIGLSRITKLDRSVLPANMKPGKDTLETVLETYKKDNKEEPATIPPVSLKVSGLTGLKELDLSGFDRETLAGLDAATLTSLEKVDISGNKLDLAPGTENRQIFDTMLSTISNHVGSNEQTVKFDKQKPTGHYPDTYGKTSLRLPVANEKVDLQSQLLFGTVTNQGTLINSEADYKAYQNHKIAGRSFVDSNYHYNNFKVSYENYTVKVTDSTLGTTTDKTLATDKEETYKVDFFSPADKTKAVHTAKVIVGDEKTMMVNLAEGATVIGGSADPVNARKVFDGQLGSETDNISLGWDSKQSIIFKLKEDGLIKHWRFFNDSARNPETTNKPIQEASLQIFNIKDYNLDNLLENPNKFDDEKYWITVDTYSAQGERATAFSNTLNNITSKYWRVVFDTKGDRYSSPVVPELQILGYPLPNADTIMKTVTTAKELSQQKDKFSQKMLDELKIKEMALETSLNSKIFDVTAINANAGVLKDCIEKRQLLKK

SEQ ID NO: 19 - DNA, 2979 bp, Artificial Sequence
  SYNTHETIC FUSION PROTEN
atgggcagcagccatcatcaccatcaccatgagctccccgggccgcgggaaaacctgtattttcagggagcgatcgctcagcaaaagtatcaaccgacagaggctaacctgaaagcccggagtgaatttcaggacaataagtttggaatcttccttcattggggactctatgccatgctcgctaccggagagtggacgatgacaaacaataacctgaattataaagagtatgccaaactggccgggggattctatccttcgaagtttgatgcagacaaatgggtagcagccatcaaggcttccggagctaaatatatttgcttcactactcgtcatcacgagggattctcgatgttcgataccaagtactctgattataacattgtaaaagcgactcctttcaaacgtgatgtggtgaaggagctggccgatgcatgtgccaaacatggcatcaaacttcacttctattattcacatatagactggtatcgtgaagatgctcctcagggaagaaccggacgtagaaccggacgtcccaatccgaaaggagattggaagagctattatcagtttatgaataatcagttgacagagctgctgactaattatggtccgatcggcgctatctggtttgacggttggtgggatcaggacatcaatcccgatttcgattgggaacttcccgagcaatatgcacttattcatcgtttgcagccggcttgcctggtaggtaacaaccaccatcagacaccttttgccggagaagatattcaaatcttcgagcgtgatttgccgggagagaatactgcaggactttcgggacaaagcgtcagccatctgcctcttgaaacatgtgagacgatgaatggtatgtggggatacaagattacagatcagaattataaatcgactaaaactttgattcactatctggtgaaagctgccggtaaagatgcaaatctgttgatgaacatcggtccgcaacctgatggtgaacttccggaagtggccgttcagcgcttgaaggaagtgggagagtggatgtcgaaatatggtgaaactatttatggaaccagaggcggtctggttgctccgcatgattggggagtaacgactcaaaaaggcaataaactttatgtacacattcttaatttacaggataaggcactcttcttgcctattgtcgataagaaagtgaaaaaggcggtggtctttgctgacaaaacaccggtacgtttcacaaagaataaggaaggaattgtactggaacttgctaaagttccaacggatgtagactacgtggtagaacttacaattgacggatccaaagataagtcgtatgatctgattgatgagaaagatttcccagataaggctttgcgagaagctgtgatggcgcaggttggaaccagaaaaggtgatttggaacgtttcaatggcacattacgattggataatccagcgattcaaagtttagaaggtctaaataaatttaaaaaattagctcaattagacttgattggcttatctcgcattacaaagctcgaccgttctgttttacccgctaatatgaagccaggcaaagataccttggaaacagttcttgaaacctataaaaaggataacaaagaagaacctgctactatcccaccagtatctttgaaggtttctggtttaactggtctgaaagaattagatttgtcaggttttgaccgtgaaaccttggctggtcttgatgccgctactctaacgtctttagaaaaagttgatatttctggcaacaaacttgatttggctccaggaacagaaaatcgacaaatttttgatactatgctatcaactatcagcaatcatgttggaagcaatgaacaaacagtgaaatttgacaagcaaaaaccaactgggcattacccagatacctatgggaaaactagtctgcgcttaccagtggcaaatgaaaaagttgatttgcaaagccagcttttgtttgggactgtgacaaatcaaggaaccctaatcaatagcgaagcagactataaggcttaccaaaatcataaaattgctggacgtagctttgttgattcaaactatcattacaataactttaaagtttcttatgagaactataccgttaaagtaactgattccacattgggaaccactactgacaaaacgctagcaactgataaagaagagacctataaggttgacttctttagcccagcagataagacaaaagctgttcatactgctaaagtgattgttggtgacgaaaaaaccatgatggttaatttggcagaaggcgcaacagttattggaggaagtgctgatcctgtaaatgcaagaaaggtatttgatgggcaactgggcagtgagactgataatatctctttaggatgggattctaagcaaagtattatatttaaattgaaagaagatggattaataaagcattggcgtttcttcaatgattcagcccgaaatcctgagacaaccaataaacctattcaggaagcaagtctacaaatttttaatatcaaagattataatctagataatttgttggaaaatcccaataaatttgatgatgaaaaatattggattactgtagatacttacagtgcacaaggagagagagctactgcattcagtaatacattaaataatattactagtaaatattggcgagttgtctttgatactaaaggagatagatatagttcgccagtagtccctgaactccaaattttaggttatccgttacctaacgccgacactatcatgaaaacagtaactactgctaaagagttatctcaacaaaaagataagttttctcaaaagatgcttgatgagttaaaaataaaagagatggctttagaaacttctttgaacagtaagatttttgatgtaactgctattaatgctaatgctggagttttgaaagattgtattgagaaaaggcagctgctaaaaaaataa

SEQ ID NO: 20 - protein, 992 aa, Artificial Sequence
  SYNTHETIC FUSION PROTEN
MGSSHHHHHHELPGPRENLYFQGAIAQQKYQPTEANLKARSEFQDNKFGIFLHWGLYAMLATGEWTMTNNNLNYKEYAKLAGGFYPSKFDADKWVAAIKASGAKYICFTTRHHEGFSMFDTKYSDYNIVKATPFKRDVVKELADACAKHGIKLHFYYSHIDWYREDAPQGRTGRRTGRPNPKGDWKSYYQFMNNQLTELLTNYGPIGAIWFDGWWDQDINPDFDWELPEQYALIHRLQPACLVGNNHHQTPFAGEDIQIFERDLPGENTAGLSGQSVSHLPLETCETMNGMWGYKITDQNYKSTKTLIHYLVKAAGKDANLLMNIGPQPDGELPEVAVQRLKEVGEWMSKYGETIYGTRGGLVAPHDWGVTTQKGNKLYVHILNLQDKALFLPIVDKKVKKAVVFADKTPVRFTKNKEGIVLELAKVPTDVDYVVELTIDGSKDKSYDLIDEKDFPDKALREAVMAQVGTRKGDLERFNGTLRLDNPAIQSLEGLNKFKKLAQLDLIGLSRITKLDRSVLPANMKPGKDTLETVLETYKKDNKEEPATIPPVSLKVSGLTGLKELDLSGFDRETLAGLDAATLTSLEKVDISGNKLDLAPGTENRQIFDTMLSTISNHVGSNEQTVKFDKQKPTGHYPDTYGKTSLRLPVANEKVDLQSQLLFGTVTNQGTLINSEADYKAYQNHKIAGRSFVDSNYHYNNFKVSYENYTVKVTDSTLGTTTDKTLATDKEETYKVDFFSPADKTKAVHTAKVIVGDEKTMMVNLAEGATVIGGSADPVNARKVFDGQLGSETDNISLGWDSKQSIIFKLKEDGLIKHWRFFNDSARNPETTNKPIQEASLQIFNIKDYNLDNLLENPNKFDDEKYWITVDTYSAQGERATAFSNTLNNITSKYWRVVFDTKGDRYSSPVVPELQILGYPLPNADTIMKTVTTAKELSQQKDKFSQKMLDELKIKEMALETSLNSKIFDVTAINANAGVLKDCIEKRQLLKK

SEQ ID NO: 21 - DNA, 4224 bp, Artificial Sequence
  SYNTHETIC FUSION PROTEN
atgggcagcagccatcatcatcatcatcacagcagcggcctggtgccgcgcggcagccatatgcagcaaaagtatcaaccgacagaggctaacctgaaagcccggagtgaatttcaggacaataagtttggaatcttccttcattggggactctatgccatgctcgctaccggagagtggacgatgacaaacaataacctgaattataaagagtatgccaaactggccgggggattctatccttcgaagtttgatgcagacaaatgggtagcagccatcaaggcttccggagctaaatatatttgcttcactactcgtcatcacgagggattctcgatgttcgataccaagtactctgattataacattgtaaaagcgactcctttcaaacgtgatgtggtgaaggagctggccgatgcatgtgccaaacatggcatcaaacttcacttctattattcacatatagactggtatcgtgaagatgctcctcagggaagaaccggacgtagaaccggacgtcccaatccgaaaggagattggaagagctattatcagtttatgaataatcagttgacagagctgctgactaattatggtccgatcggcgctatctggtttgacggttggtgggatcaggacatcaatcccgatttcgattgggaacttcccgagcaatatgcacttattcatcgtttgcagccggcttgcctggtaggtaacaaccaccatcagacaccttttgccggagaagatattcaaatcttcgagcgtgatttgccgggagagaatactgcaggactttcgggacaaagcgtcagccatctgcctcttgaaacatgtgagacgatgaatggtatgtggggatacaagattacagatcagaattataaatcgactaaaactttgattcactatctggtgaaagctgccggtaaagatgcaaatctgttgatgaacatcggtccgcaacctgatggtgaacttccggaagtggccgttcagcgcttgaaggaagtgggagagtggatgtcgaaatatggtgaaactatttatggaaccagaggcggtctggttgctccgcatgattggggagtaacgactcaaaaaggcaataaactttatgtacacattcttaatttacaggataaggcactcttcttgcctattgtcgataagaaagtgaaaaaggcggtggtctttgctgacaaaacaccggtacgtttcacaaagaataaggaaggaattgtactggaacttgctaaagttccaacggatgtagactacgtggtagaacttacaattgacggatccacccaccatgattcactcaatactgtaaaagcggaggagaagactgttcaggttcagaaaggattaccttctatcgatagcttgcattatctgtcagagaatagcaaaaaagaatttaaagaagaactctcaaaagcggggcaagaatctcaaaaggtcaaagagatattagcaaaagctcagcaggcagataaacaagctcaagaacttgccaaaatgaaaattcctgagaaaataccgatgaaaccgttacatggttctctctacggtggttactttagaacttggcatgacaaaacatcagatccaacagaaaaagacaaagttaactcgatgggagagcttcctaaagaagtagatctagcctttattttccacgattggacaaaagattatagccttttttggaaagaattggccaccaaacatgtgccaaagttaaacaagcaagggacacgtgtcattcgtaccattccatggcgtttcctagctgggggtgataacagtggtattgcagaagataccagtaaatacccaaatacaccagagggaaataaagctttagccaaagctattgttgatgaatatgtttataaatacaaccttgatggcttagatgtggatgttgaacatgatagtattccaaaagttgacaaaaaagaagatacagcaggcgtagaacgctctattcaagtgtttgaagaaattgggaaattaattggaccaaaaggtgttgataaatcgcggttatttattatggatagcacctacatggctgataaaaacccattgattgagcgaggagctccttatattaatttattactggtacaggtctatggttcacaaggagagaaaggtggttgggagcctgtttctaatcgacctgaaaaaacaatggaagaacgatggcaaggttatagcaagtatattcgtcctgaacaatacatgattggtttttctttctatgaggaaaatgctcaagaagggaatctttggtatgatattaattctcgcaaggacgaggacaaagcaaatggaattaacactgacataactggaacgcgtgccgaacggtatgcaaggtggcaacctaagacaggtggggttaagggaggtatcttctcctacgctattgaccgagatggtgtagctcatcaacctaaaaaatatgctaaacagaaagagtttaaggacgcaactgataacatcttccactcagattatagtgtctccaaggcattaaagacagttatgctaaaagataagtcgtatgatctgattgatgagaaagatttcccagataaggctttgcgagaagctgtgatggcgcaggttggaaccagaaaaggtgatttggaacgtttcaatggcacattacgattggataatccagcgattcaaagtttagaaggtctaaataaatttaaaaaattagctcaattagacttgattggcttatctcgcattacaaagctcgaccgttctgttttacccgctaatatgaagccaggcaaagataccttggaaacagttcttgaaacctataaaaaggataacaaagaagaacctgctactatcccaccagtatctttgaaggtttctggtttaactggtctgaaagaattagatttgtcaggttttgaccgtgaaaccttggctggtcttgatgccgctactctaacgtctttagaaaaagttgatatttctggcaacaaacttgatttggctccaggaacagaaaatcgacaaatttttgatactatgctatcaactatcagcaatcatgttggaagcaatgaacaaacagtgaaatttgacaagcaaaaaccaactgggcattacccagatacctatgggaaaactagtctgcgcttaccagtggcaaatgaaaaagttgatttgcaaagccagcttttgtttgggactgtgacaaatcaaggaaccctaatcaatagcgaagcagactataaggcttaccaaaatcataaaattgctggacgtagctttgttgattcaaactatcattacaataactttaaagtttcttatgagaactataccgttaaagtaactgattccacattgggaaccactactgacaaaacgctagcaactgataaagaagagacctataaggttgacttctttagcccagcagataagacaaaagctgttcatactgctaaagtgattgttggtgacgaaaaaaccatgatggttaatttggcagaaggcgcaacagttattggaggaagtgctgatcctgtaaatgcaagaaaggtatttgatgggcaactgggcagtgagactgataatatctctttaggatgggattctaagcaaagtattatatttaaattgaaagaagatggattaataaagcattggcgtttcttcaatgattcagcccgaaatcctgagacaaccaataaacctattcaggaagcaagtctacaaatttttaatatcaaagattataatctagataatttgttggaaaatcccaataaatttgatgatgaaaaatattggattactgtagatacttacagtgcacaaggagagagagctactgcattcagtaatacattaaataatattactagtaaatattggcgagttgtctttgatactaaaggagatagatatagttcgccagtagtccctgaactccaaattttaggttatccgttacctaacgccgacactatcatgaaaacagtaactactgctaaagagttatctcaacaaaaagataagttttctcaaaagatgcttgatgagttaaaaataaaagagatggctttagaaacttctttgaacagtaagatttttgatgtaactgctattaatgctaatgctggagttttgaaagattgtattgagaaaaggcagctgctaaaaaaataa

SEQ ID NO: 22 - protein, 1407 aa, Artificial Sequence
  SYNTHETIC FUSION PROTEN
MGSSHHHHHHSSGLVPRGSHMQQKYQPTEANLKARSEFQDNKFGIFLHWGLYAMLATGEWTMTNNNLNYKEYAKLAGGFYPSKFDADKWVAAIKASGAKYICFTTRHHEGFSMFDTKYSDYNIVKATPFKRDVVKELADACAKHGIKLHFYYSHIDWYREDAPQGRTGRRTGRPNPKGDWKSYYQFMNNQLTELLTNYGPIGAIWFDGWWDQDINPDFDWELPEQYALIHRLQPACLVGNNHHQTPFAGEDIQIFERDLPGENTAGLSGQSVSHLPLETCETMNGMWGYKITDQNYKSTKTLIHYLVKAAGKDANLLMNIGPQPDGELPEVAVQRLKEVGEWMSKYGETIYGTRGGLVAPHDWGVTTQKGNKLYVHILNLQDKALFLPIVDKKVKKAVVFADKTPVRFTKNKEGIVLELAKVPTDVDYVVELTIDGSTHHDSLNTVKAEEKTVQVQKGLPSIDSLHYLSENSKKEFKEELSKAGQESQKVKEILAKAQQADKQAQELAKMKIPEKIPMKPLHGSLYGGYFRTWHDKTSDPTEKDKVNSMGELPKEVDLAFIFHDWTKDYSLFWKELATKHVPKLNKQGTRVIRTIPWRFLAGGDNSGIAEDTSKYPNTPEGNKALAKAIVDEYVYKYNLDGLDVDVEHDSIPKVDKKEDTAGVERSIQVFEEIGKLIGPKGVDKSRLFIMDSTYMADKNPLIERGAPYINLLLVQVYGSQGEKGGWEPVSNRPEKTMEERWQGYSKYIRPEQYMIGFSFYEENAQEGNLWYDINSRKDEDKANGINTDITGTRAERYARWQPKTGGVKGGIFSYAIDRDGVAHQPKKYAKQKEFKDATDNIFHSDYSVSKALKTVMLKDKSYDLIDEKDFPDKALREAVMAQVGTRKGDLERFNGTLRLDNPAIQSLEGLNKFKKLAQLDLIGLSRITKLDRSVLPANMKPGKDTLETVLETYKKDNKEEPATIPPVSLKVSGLTGLKELDLSGFDRETLAGLDAATLTSLEKVDISGNKLDLAPGTENRQIFDTMLSTISNHVGSNEQTVKFDKQKPTGHYPDTYGKTSLRLPVANEKVDLQSQLLFGTVTNQGTLINSEADYKAYQNHKIAGRSFVDSNYHYNNFKVSYENYTVKVTDSTLGTTTDKTLATDKEETYKVDFFSPADKTKAVHTAKVIVGDEKTMMVNLAEGATVIGGSADPVNARKVFDGQLGSETDNISLGWDSKQSIIFKLKEDGLIKHWRFFNDSARNPETTNKPIQEASLQIFNIKDYNLDNLLENPNKFDDEKYWITVDTYSAQGERATAFSNTLNNITSKYWRVVFDTKGDRYSSPVVPELQILGYPLPNADTIMKTVTTAKELSQQKDKFSQKMLDELKIKEMALETSLNSKIFDVTAINANAGVLKDCIEKRQLLKK

SEQ ID NO: 23 - DNA, 4224 bp, Artificial Sequence
  SYNTHETIC FUSION PROTEN
atgggcagcagccatcatcatcatcatcacagcagcggcctggtgccgcgcggcagccatatgcagcaaaagtatcaaccgacagaggctaacctgaaagcccggagtgaatttcaggacaataagtttggaatcttccttcattggggactctatgccatgctcgctaccggagagtggacgatgacaaacaataacctgaattataaagagtatgccaaactggccgggggattctatccttcgaagtttgatgcagacaaatgggtagcagccatcaaggcttccggagctaaatatatttgcttcactactcgtcatcacgagggattctcgatgttcgataccaagtactctgattataacattgtaaaagcgactcctttcaaacgtgatgtggtgaaggagctggccgatgcatgtgccaaacatggcatcaaacttcacttctattattcacatatagactggtatcgtgaagatgctcctcagggaagaaccggacgtagaaccggacgtcccaatccgaaaggagattggaagagctattatcagtttatgaataatcagttgacagagctgctgactaattatggtccgatcggcgctatctggtttgacggttggtgggatcaggacatcaatcccgatttcgattgggaacttcccgagcaatatgcacttattcatcgtttgcagccggcttgcctggtaggtaacaaccaccatcagacaccttttgccggagaagatattcaaatcttcgagcgtgatttgccgggagagaatactgcaggactttcgggacaaagcgtcagccatctgcctcttgaaacatgtgagacgatgaatggtatgtggggatacaagattacagatcagaattataaatcgactaaaactttgattcactatctggtgaaagctgccggtaaagatgcaaatctgttgatgaacatcggtccgcaacctgatggtgaacttccggaagtggccgttcagcgcttgaaggaagtgggagagtggatgtcgaaatatggtgaaactatttatggaaccagaggcggtctggttgctccgcatgattggggagtaacgactcaaaaaggcaataaactttatgtacacattcttaatttacaggataaggcactcttcttgcctattgtcgataagaaagtgaaaaaggcggtggtctttgctgacaaaacaccggtacgtttcacaaagaataaggaaggaattgtactggaacttgctaaagttccaacggatgtagactacgtggtagaacttacaattgacggatccacccaccatgattcactcaatactgtaaaagcggaggagaagactgttcaggttcagaaaggattaccttctatcgatagcttgcattatctgtcagagaatagcaaaaaagaatttaaagaagaactctcaaaagcggggcaagaatctcaaaaggtcaaagagatattagcaaaagctcagcaggcagataaacaagctcaagaacttgccaaaatgaaaattcctgagaaaataccgatgaaaccgttacatggttctctctacggtggttactttagaacttggcatgacaaaacatcagatccaacagaaaaagacaaagttaactcgatgggagagcttcctaaagaagtagatctagcctttattttccacgattggacaaaagattatagccttttttggaaagaattggccaccaaacatgtgccaaagttaaacaagcaagggacacgtgtcattcgtaccattccatggcgtttcctagctgggggtgataacagtggtattgcagaagataccagtaaatacccaaatacaccagagggaaataaagctttagccaaagctattgttgatgaatatgtttataaatacaaccttgatggcttagatgtgcaggttgaacatgatagtattccaaaagttgacaaaaaagaagatacagcaggcgtagaacgctctattcaagtgtttgaagaaattgggaaattaattggaccaaaaggtgttgataaatcgcggttatttattatggatagcacctacatggctgataaaaacccattgattgagcgaggagctccttatattaatttattactggtacaggtctatggttcacaaggagagaaaggtggttgggagcctgtttctaatcgacctgaaaaaacaatggaagaacgatggcaaggttatagcaagtatattcgtcctgaacaatacatgattggtttttctttctatgaggaaaatgctcaagaagggaatctttggtatgatattaattctcgcaaggacgaggacaaagcaaatggaattaacactgacataactggaacgcgtgccgaacggtatgcaaggtggcaacctaagacaggtggggttaagggaggtatcttctcctacgctattgaccgagatggtgtagctcatcaacctaaaaaatatgctaaacagaaagagtttaaggacgcaactgataacatcttccactcagattatagtgtctccaaggcattaaagacagttatgctaaaagataagtcgtatgatctgattgatgagaaagatttcccagataaggctttgcgagaagctgtgatggcgcaggttggaaccagaaaaggtgatttggaacgtttcaatggcacattacgattggataatccagcgattcaaagtttagaaggtctaaataaatttaaaaaattagctcaattagacttgattggcttatctcgcattacaaagctcgaccgttctgttttacccgctaatatgaagccaggcaaagataccttggaaacagttcttgaaacctataaaaaggataacaaagaagaacctgctactatcccaccagtatctttgaaggtttctggtttaactggtctgaaagaattagatttgtcaggttttgaccgtgaaaccttggctggtcttgatgccgctactctaacgtctttagaaaaagttgatatttctggcaacaaacttgatttggctccaggaacagaaaatcgacaaatttttgatactatgctatcaactatcagcaatcatgttggaagcaatgaacaaacagtgaaatttgacaagcaaaaaccaactgggcattacccagatacctatgggaaaactagtctgcgcttaccagtggcaaatgaaaaagttgatttgcaaagccagcttttgtttgggactgtgacaaatcaaggaaccctaatcaatagcgaagcagactataaggcttaccaaaatcataaaattgctggacgtagctttgttgattcaaactatcattacaataactttaaagtttcttatgagaactataccgttaaagtaactgattccacattgggaaccactactgacaaaacgctagcaactgataaagaagagacctataaggttgacttctttagcccagcagataagacaaaagctgttcatactgctaaagtgattgttggtgacgaaaaaaccatgatggttaatttggcagaaggcgcaacagttattggaggaagtgctgatcctgtaaatgcaagaaaggtatttgatgggcaactgggcagtgagactgataatatctctttaggatgggattctaagcaaagtattatatttaaattgaaagaagatggattaataaagcattggcgtttcttcaatgattcagcccgaaatcctgagacaaccaataaacctattcaggaagcaagtctacaaatttttaatatcaaagattataatctagataatttgttggaaaatcccaataaatttgatgatgaaaaatattggattactgtagatacttacagtgcacaaggagagagagctactgcattcagtaatacattaaataatattactagtaaatattggcgagttgtctttgatactaaaggagatagatatagttcgccagtagtccctgaactccaaattttaggttatccgttacctaacgccgacactatcatgaaaacagtaactactgctaaagagttatctcaacaaaaagataagttttctcaaaagatgcttgatgagttaaaaataaaagagatggctttagaaacttctttgaacagtaagatttttgatgtaactgctattaatgctaatgctggagttttgaaagattgtattgagaaaaggcagctgctaaaaaaataa

SEQ ID NO: 24 - protein, 1407 aa, Artificial Sequence
  SYNTHETIC FUSION PROTEN
MGSSHHHHHHSSGLVPRGSHMQQKYQPTEANLKARSEFQDNKFGIFLHWGLYAMLATGEWTMTNNNLNYKEYAKLAGGFYPSKFDADKWVAAIKASGAKYICFTTRHHEGFSMFDTKYSDYNIVKATPFKRDVVKELADACAKHGIKLHFYYSHIDWYREDAPQGRTGRRTGRPNPKGDWKSYYQFMNNQLTELLTNYGPIGAIWFDGWWDQDINPDFDWELPEQYALIHRLQPACLVGNNHHQTPFAGEDIQIFERDLPGENTAGLSGQSVSHLPLETCETMNGMWGYKITDQNYKSTKTLIHYLVKAAGKDANLLMNIGPQPDGELPEVAVQRLKEVGEWMSKYGETIYGTRGGLVAPHDWGVTTQKGNKLYVHILNLQDKALFLPIVDKKVKKAVVFADKTPVRFTKNKEGIVLELAKVPTDVDYVVELTIDGSTHHDSLNTVKAEEKTVQVQKGLPSIDSLHYLSENSKKEFKEELSKAGQESQKVKEILAKAQQADKQAQELAKMKIPEKIPMKPLHGSLYGGYFRTWHDKTSDPTEKDKVNSMGELPKEVDLAFIFHDWTKDYSLFWKELATKHVPKLNKQGTRVIRTIPWRFLAGGDNSGIAEDTSKYPNTPEGNKALAKAIVDEYVYKYNLDGLDVQVEHDSIPKVDKKEDTAGVERSIQVFEEIGKLIGPKGVDKSRLFIMDSTYMADKNPLIERGAPYINLLLVQVYGSQGEKGGWEPVSNRPEKTMEERWQGYSKYIRPEQYMIGFSFYEENAQEGNLWYDINSRKDEDKANGINTDITGTRAERYARWQPKTGGVKGGIFSYAIDRDGVAHQPKKYAKQKEFKDATDNIFHSDYSVSKALKTVMLKDKSYDLIDEKDFPDKALREAVMAQVGTRKGDLERFNGTLRLDNPAIQSLEGLNKFKKLAQLDLIGLSRITKLDRSVLPANMKPGKDTLETVLETYKKDNKEEPATIPPVSLKVSGLTGLKELDLSGFDRETLAGLDAATLTSLEKVDISGNKLDLAPGTENRQIFDTMLSTISNHVGSNEQTVKFDKQKPTGHYPDTYGKTSLRLPVANEKVDLQSQLLFGTVTNQGTLINSEADYKAYQNHKIAGRSFVDSNYHYNNFKVSYENYTVKVTDSTLGTTTDKTLATDKEETYKVDFFSPADKTKAVHTAKVIVGDEKTMMVNLAEGATVIGGSADPVNARKVFDGQLGSETDNISLGWDSKQSIIFKLKEDGLIKHWRFFNDSARNPETTNKPIQEASLQIFNIKDYNLDNLLENPNKFDDEKYWITVDTYSAQGERATAFSNTLNNITSKYWRVVFDTKGDRYSSPVVPELQILGYPLPNADTIMKTVTTAKELSQQKDKFSQKMLDELKIKEMALETSLNSKIFDVTAINANAGVLKDCIEKRQLLKK

SEQ ID NO: 25 - DNA, 3924 bp, Artificial Sequence
  SYNTHETIC FUSION PROTEN
atgggcagcagccatcatcatcatcatcacagcagcggcctggtgccgcgcggcagccatatgggcagcagccatcatcaccatcaccatgagctccccgggccgcgggaaaacctgtattttcagggagcgatcgctcagcaaaagtatcaaccgacagaggctaacctgaaagcccggagtgaatttcaggacaataagtttggaatcttccttcattggggactctatgccatgctcgctaccggagagtggacgatgacaaacaataacctgaattataaagagtatgccaaactggccgggggattctatccttcgaagtttgatgcagacaaatgggtagcagccatcaaggcttccggagctaaatatatttgcttcactactcgtcatcacgagggattctcgatgttcgataccaagtactctgattataacattgtaaaagcgactcctttcaaacgtgatgtggtgaaggagctggccgatgcatgtgccaaacatggcatcaaacttcacttctattattcacatatagactggtatcgtgaagatgctcctcagggaagaaccggacgtagaaccggacgtcccaatccgaaaggagattggaagagctattatcagtttatgaataatcagttgacagagctgctgactaattatggtccgatcggcgctatctggtttgacggttggtgggatcaggacatcaatcccgatttcgattgggaacttcccgagcaatatgcacttattcatcgtttgcagccggcttgcctggtaggtaacaaccaccatcagacaccttttgccggagaagatattcaaatcttcgagcgtgatttgccgggagagaatactgcaggactttcgggacaaagcgtcagccatctgcctcttgaaacatgtgagacgatgaatggtatgtggggatacaagattacagatcagaattataaatcgactaaaactttgattcactatctggtgaaagctgccggtaaagatgcaaatctgttgatgaacatcggtccgcaacctgatggtgaacttccggaagtggccgttcagcgcttgaaggaagtgggagagtggatgtcgaaatatggtgaaactatttatggaaccagaggcggtctggttgctccgcatgattggggagtaacgactcaaaaaggcaataaactttatgtacacattcttaatttacaggataaggcactcttcttgcctattgtcgataagaaagtgaaaaaggcggtggtctttgctgacaaaacaccggtacgtttcacaaagaataaggaaggaattgtactggaacttgctaaagttccaacggatgtagactacgtggtagaacttacaattgacggatccatggataaacatttgttggtaaaaagaacactagggtgtgtttgtgctgcaacgttgatgggagctgccttagcgacccaccatgattcactcaatactgtaaaagcggaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcagacaattggtgttaacgaattaaatggacgtacaggtttatctaaagattatcctgatactcctgaggggaacaaagctttagcagcagccattgtcaaggcatttgtaactgatcgtggtgtcgatggactagatattgatattgagcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggatgaattctaa

SEQ ID NO: 26 - protein, 1307 aa, Artificial Sequence
  SYNTHETIC FUSION PROTEN
MGSSHHHHHHSSGLVPRGSHMGSSHHHHHHELPGPRENLYFQGAIAQQKYQPTEANLKARSEFQDNKFGIFLHWGLYAMLATGEWTMTNNNLNYKEYAKLAGGFYPSKFDADKWVAAIKASGAKYICFTTRHHEGFSMFDTKYSDYNIVKATPFKRDVVKELADACAKHGIKLHFYYSHIDWYREDAPQGRTGRRTGRPNPKGDWKSYYQFMNNQLTELLTNYGPIGAIWFDGWWDQDINPDFDWELPEQYALIHRLQPACLVGNNHHQTPFAGEDIQIFERDLPGENTAGLSGQSVSHLPLETCETMNGMWGYKITDQNYKSTKTLIHYLVKAAGKDANLLMNIGPQPDGELPEVAVQRLKEVGEWMSKYGETIYGTRGGLVAPHDWGVTTQKGNKLYVHILNLQDKALFLPIVDKKVKKAVVFADKTPVRFTKNKEGIVLELAKVPTDVDYVVELTIDGSMDKHLLVKRTLGCVCAATLMGAALATHHDSLNTVKAEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQTIGVNELNGRTGLSKDYPDTPEGNKALAAAIVKAFVTDRGVDGLDIDIEHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKDEF

SEQ ID NO: 27 - DNA, 3924 bp, Artificial Sequence
  SYNTHETIC FUSION PROTEN
atgggcagcagccatcatcatcatcatcacagcagcggcctggtgccgcgcggcagccatatgggcagcagccatcatcaccatcaccatgagctccccgggccgcgggaaaacctgtattttcagggagcgatcgctcagcaaaagtatcaaccgacagaggctaacctgaaagcccggagtgaatttcaggacaataagtttggaatcttccttcattggggactctatgccatgctcgctaccggagagtggacgatgacaaacaataacctgaattataaagagtatgccaaactggccgggggattctatccttcgaagtttgatgcagacaaatgggtagcagccatcaaggcttccggagctaaatatatttgcttcactactcgtcatcacgagggattctcgatgttcgataccaagtactctgattataacattgtaaaagcgactcctttcaaacgtgatgtggtgaaggagctggccgatgcatgtgccaaacatggcatcaaacttcacttctattattcacatatagactggtatcgtgaagatgctcctcagggaagaaccggacgtagaaccggacgtcccaatccgaaaggagattggaagagctattatcagtttatgaataatcagttgacagagctgctgactaattatggtccgatcggcgctatctggtttgacggttggtgggatcaggacatcaatcccgatttcgattgggaacttcccgagcaatatgcacttattcatcgtttgcagccggcttgcctggtaggtaacaaccaccatcagacaccttttgccggagaagatattcaaatcttcgagcgtgatttgccgggagagaatactgcaggactttcgggacaaagcgtcagccatctgcctcttgaaacatgtgagacgatgaatggtatgtggggatacaagattacagatcagaattataaatcgactaaaactttgattcactatctggtgaaagctgccggtaaagatgcaaatctgttgatgaacatcggtccgcaacctgatggtgaacttccggaagtggccgttcagcgcttgaaggaagtgggagagtggatgtcgaaatatggtgaaactatttatggaaccagaggcggtctggttgctccgcatgattggggagtaacgactcaaaaaggcaataaactttatgtacacattcttaatttacaggataaggcactcttcttgcctattgtcgataagaaagtgaaaaaggcggtggtctttgctgacaaaacaccggtacgtttcacaaagaataaggaaggaattgtactggaacttgctaaagttccaacggatgtagactacgtggtagaacttacaattgacggatccatggataaacatttgttggtaaaaagaacactagggtgtgtttgtgctgcaacgttgatgggagctgccttagcgacccaccatgattcactcaatactgtaaaagcggaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcaggaaattggtgttaacgaattaaatggacgtacaggtttatctaaagattatcctgatactcctgaggggaacaaagctttagcagcagccattgtcaaggcatttgtaactgatcgtggtgtcgatggactagatattgatattgagcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggatgaattctaa

SEQ ID NO: 28 - protein, 1307 aa, Artificial Sequence
  SYNTHETIC FUSION PROTEN
MGSSHHHHHHSSGLVPRGSHMGSSHHHHHHELPGPRENLYFQGAIAQQKYQPTEANLKARSEFQDNKFGIFLHWGLYAMLATGEWTMTNNNLNYKEYAKLAGGFYPSKFDADKWVAAIKASGAKYICFTTRHHEGFSMFDTKYSDYNIVKATPFKRDVVKELADACAKHGIKLHFYYSHIDWYREDAPQGRTGRRTGRPNPKGDWKSYYQFMNNQLTELLTNYGPIGAIWFDGWWDQDINPDFDWELPEQYALIHRLQPACLVGNNHHQTPFAGEDIQIFERDLPGENTAGLSGQSVSHLPLETCETMNGMWGYKITDQNYKSTKTLIHYLVKAAGKDANLLMNIGPQPDGELPEVAVQRLKEVGEWMSKYGETIYGTRGGLVAPHDWGVTTQKGNKLYVHILNLQDKALFLPIVDKKVKKAVVFADKTPVRFTKNKEGIVLELAKVPTDVDYVVELTIDGSMDKHLLVKRTLGCVCAATLMGAALATHHDSLNTVKAEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQEIGVNELNGRTGLSKDYPDTPEGNKALAAAIVKAFVTDRGVDGLDIDIEHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKDEF

SEQ ID NO: 29 - DNA, 3924 bp, Artificial Sequence
  SYNTHETIC FUSION PROTEN
atgggcagcagccatcatcatcatcatcacagcagcggcctggtgccgcgcggcagccatatgggcagcagccatcatcaccatcaccatgagctccccgggccgcgggaaaacctgtattttcagggagcgatcgctcagcaaaagtatcaaccgacagaggctaacctgaaagcccggagtgaatttcaggacaataagtttggaatcttccttcattggggactctatgccatgctcgctaccggagagtggacgatgacaaacaataacctgaattataaagagtatgccaaactggccgggggattctatccttcgaagtttgatgcagacaaatgggtagcagccatcaaggcttccggagctaaatatatttgcttcactactcgtcatcacgagggattctcgatgttcgataccaagtactctgattataacattgtaaaagcgactcctttcaaacgtgatgtggtgaaggagctggccgatgcatgtgccaaacatggcatcaaacttcacttctattattcacatatagactggtatcgtgaagatgctcctcagggaagaaccggacgtagaaccggacgtcccaatccgaaaggagattggaagagctattatcagtttatgaataatcagttgacagagctgctgactaattatggtccgatcggcgctatctggtttgacggttggtgggatcaggacatcaatcccgatttcgattgggaacttcccgagcaatatgcacttattcatcgtttgcagccggcttgcctggtaggtaacaaccaccatcagacaccttttgccggagaagatattcaaatcttcgagcgtgatttgccgggagagaatactgcaggactttcgggacaaagcgtcagccatctgcctcttgaaacatgtgagacgatgaatggtatgtggggatacaagattacagatcagaattataaatcgactaaaactttgattcactatctggtgaaagctgccggtaaagatgcaaatctgttgatgaacatcggtccgcaacctgatggtgaacttccggaagtggccgttcagcgcttgaaggaagtgggagagtggatgtcgaaatatggtgaaactatttatggaaccagaggcggtctggttgctccgcatgattggggagtaacgactcaaaaaggcaataaactttatgtacacattcttaatttacaggataaggcactcttcttgcctattgtcgataagaaagtgaaaaaggcggtggtctttgctgacaaaacaccggtacgtttcacaaagaataaggaaggaattgtactggaacttgctaaagttccaacggatgtagactacgtggtagaacttacaattgacggatccatggataaacatttgttggtaaaaagaacactagggtgtgtttgtgctgcaacgttgatgggagctgccttagcgacccaccatgattcactcaatactgtaaaagcggaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcagatgattggtgttaacgaattaaatggacgtacaggtttatctaaagattatcctgatactcctgaggggaacaaagctttagcagcagccattgtcaaggcatttgtaactgatcgtggtgtcgatggactagatattgatattgagcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggatgaattctaa

SEQ ID NO: 30 - protein, 1307 aa, Artificial Sequence
  SYNTHETIC FUSION PROTEN
MGSSHHHHHHSSGLVPRGSHMGSSHHHHHHELPGPRENLYFQGAIAQQKYQPTEANLKARSEFQDNKFGIFLHWGLYAMLATGEWTMTNNNLNYKEYAKLAGGFYPSKFDADKWVAAIKASGAKYICFTTRHHEGFSMFDTKYSDYNIVKATPFKRDVVKELADACAKHGIKLHFYYSHIDWYREDAPQGRTGRRTGRPNPKGDWKSYYQFMNNQLTELLTNYGPIGAIWFDGWWDQDINPDFDWELPEQYALIHRLQPACLVGNNHHQTPFAGEDIQIFERDLPGENTAGLSGQSVSHLPLETCETMNGMWGYKITDQNYKSTKTLIHYLVKAAGKDANLLMNIGPQPDGELPEVAVQRLKEVGEWMSKYGETIYGTRGGLVAPHDWGVTTQKGNKLYVHILNLQDKALFLPIVDKKVKKAVVFADKTPVRFTKNKEGIVLELAKVPTDVDYVVELTIDGSMDKHLLVKRTLGCVCAATLMGAALATHHDSLNTVKAEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQMIGVNELNGRTGLSKDYPDTPEGNKALAAAIVKAFVTDRGVDGLDIDIEHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKDEF

SEQ ID NO: 31 - DNA, 3924 bp, Artificial Sequence
  SYNTHETIC FUSION PROTEN
atgggcagcagccatcatcatcatcatcacagcagcggcctggtgccgcgcggcagccatatgggcagcagccatcatcaccatcaccatgagctccccgggccgcgggaaaacctgtattttcagggagcgatcgctcagcaaaagtatcaaccgacagaggctaacctgaaagcccggagtgaatttcaggacaataagtttggaatcttccttcattggggactctatgccatgctcgctaccggagagtggacgatgacaaacaataacctgaattataaagagtatgccaaactggccgggggattctatccttcgaagtttgatgcagacaaatgggtagcagccatcaaggcttccggagctaaatatatttgcttcactactcgtcatcacgagggattctcgatgttcgataccaagtactctgattataacattgtaaaagcgactcctttcaaacgtgatgtggtgaaggagctggccgatgcatgtgccaaacatggcatcaaacttcacttctattattcacatatagactggtatcgtgaagatgctcctcagggaagaaccggacgtagaaccggacgtcccaatccgaaaggagattggaagagctattatcagtttatgaataatcagttgacagagctgctgactaattatggtccgatcggcgctatctggtttgacggttggtgggatcaggacatcaatcccgatttcgattgggaacttcccgagcaatatgcacttattcatcgtttgcagccggcttgcctggtaggtaacaaccaccatcagacaccttttgccggagaagatattcaaatcttcgagcgtgatttgccgggagagaatactgcaggactttcgggacaaagcgtcagccatctgcctcttgaaacatgtgagacgatgaatggtatgtggggatacaagattacagatcagaattataaatcgactaaaactttgattcactatctggtgaaagctgccggtaaagatgcaaatctgttgatgaacatcggtccgcaacctgatggtgaacttccggaagtggccgttcagcgcttgaaggaagtgggagagtggatgtcgaaatatggtgaaactatttatggaaccagaggcggtctggttgctccgcatgattggggagtaacgactcaaaaaggcaataaactttatgtacacattcttaatttacaggataaggcactcttcttgcctattgtcgataagaaagtgaaaaaggcggtggtctttgctgacaaaacaccggtacgtttcacaaagaataaggaaggaattgtactggaacttgctaaagttccaacggatgtagactacgtggtagaacttacaattgacggatccatggataaacatttgttggtaaaaagaacactagggtgtgtttgtgctgcaacgttgatgggagctgccttagcgacccaccatgattcactcaatactgtaaaagcggaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcagacaattggtgttaacgaattaaatggacgtacaggtttatctaaagattatcctgatactcctgaggggaacaaagctttagcagcagccattgtcaaggcatttgtaactgatcgtggtgtcgatggactagatattatgattgagcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggatgaattctaa

SEQ ID NO: 32 - protein, 1307 aa, Artificial Sequence
  SYNTHETIC FUSION PROTEN
MGSSHHHHHHSSGLVPRGSHMGSSHHHHHHELPGPRENLYFQGAIAQQKYQPTEANLKARSEFQDNKFGIFLHWGLYAMLATGEWTMTNNNLNYKEYAKLAGGFYPSKFDADKWVAAIKASGAKYICFTTRHHEGFSMFDTKYSDYNIVKATPFKRDVVKELADACAKHGIKLHFYYSHIDWYREDAPQGRTGRRTGRPNPKGDWKSYYQFMNNQLTELLTNYGPIGAIWFDGWWDQDINPDFDWELPEQYALIHRLQPACLVGNNHHQTPFAGEDIQIFERDLPGENTAGLSGQSVSHLPLETCETMNGMWGYKITDQNYKSTKTLIHYLVKAAGKDANLLMNIGPQPDGELPEVAVQRLKEVGEWMSKYGETIYGTRGGLVAPHDWGVTTQKGNKLYVHILNLQDKALFLPIVDKKVKKAVVFADKTPVRFTKNKEGIVLELAKVPTDVDYVVELTIDGSMDKHLLVKRTLGCVCAATLMGAALATHHDSLNTVKAEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQTIGVNELNGRTGLSKDYPDTPEGNKALAAAIVKAFVTDRGVDGLDIMIEHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKDEF

SEQ ID NO: 33 - DNA, 2772 bp, Artificial Sequence
  SYNTHETIC FUSION PROTEN
atgggcagcagccatcatcatcatcatcacagcagcggcctggtgccgcgcggcagccatatgggtaccctgcagggatccaaagataagtcgtatgatctgattgatgagaaagatttcccagataaggctttgcgagaagctgtgatggcgcaggttggaaccagaaaaggtgatttggaacgtttcaatggcacattacgattggataatccagcgattcaaagtttagaaggtctaaataaatttaaaaaattagctcaattagacttgattggcttatctcgcattacaaagctcgaccgttctgttttacccgctaatatgaagccaggcaaagataccttggaaacagttcttgaaacctataaaaaggataacaaagaagaacctgctactatcccaccagtatctttgaaggtttctggtttaactggtctgaaagaattagatttgtcaggttttgaccgtgaaaccttggctggtcttgatgccgctactctaacgtctttagaaaaagttgatatttctggcaacaaacttgatttggctccaggaacagaaaatcgacaaatttttgatactatgctatcaactatcagcaatcatgttggaagcaatgaacaaacagtgaaatttgacaagcaaaaaccaactgggcattacccagatacctatgggaaaactagtctgcgcttaccagtggcaaatgaaaaagttgatttgcaaagccagcttttgtttgggactgtgacaaatcaaggaaccctaatcaatagcgaagcagactataaggcttaccaaaatcataaaattgctggacgtagctttgttgattcaaactatcattacaataactttaaagtttcttatgagaactataccgttaaagtaactgattccacattgggaaccactactgacaaaacgctagcaactgataaagaagagacctataaggttgacttctttagcccagcagataagacaaaagctgttcatactgctaaagtgattgttggtgacgaaaaaaccatgatggttaatttggcagaaggcgcaacagttattggaggaagtgctgatcctgtaaatgcaagaaaggtatttgatgggcaactgggcagtgagactgataatatctctttaggatgggattctaagcaaagtattatatttaaattgaaagaagatggattaataaagcattggcgtttcttcaatgattcagcccgaaatcctgagacaaccaataaacctattcaggaagcaagtctacaaatttttaatatcaaagattataatctagataatttgttggaaaatcccaataaatttgatgatgaaaaatattggattactgtagatacttacagtgcacaaggagagagagctactgcattcagtaatacattaaataatattactagtaaatattggcgagttgtctttgatactaaaggagatagatatagttcgccagtagtccctgaactccaaattttaggttatccgttacctaacgccgacactatcatgaaaacagtaactactgctaaagagttatctcaacaaaaagataagttttctcaaaagatgcttgatgagttaaaaataaaagagatggctttagaaacttctttgaacagtaagatttttgatgtaactgctattaatgctaatgctggagttttgaaagattgtattgagaaaaggcagctgctaaaaaaaggcggtgcaaacgacaacgtggcgtggttcaagcaggcgaaatatggcatgatgattcactggggtctgtacagcctgctggcgggcgagtatcgtggtgaaagcagcagcgcgtacgcggagtggatccagagcaagtttcaaattccgaacgcggaatacggcaacctggcgaccgcgttcaacccgctgtattttgatgcgaagaaaatcgttgcgctggcgaaacagtgcggcatgcaatacctggtggttaccaccaagcaccacgacggtttcgcgatgtatcacagcaaagtggacgcgtacaacgtttatgatgcgaccccgtttcaccgtgatatcattggcgagctggcggaagcgtgccagaaggcgggtctgaaattcggtctgtactatagccaagacctggattggcacgacccgaacggtggcggttataagagcaacgatgtggagaccgcgggtaccacctgggacaacagctgggatttcccggacgaagatcagaaaaacttcgacctgtgctttgataacaagatcctgccgcaaatcaaagagattatgagcaactacggtgacattgcgaccgcgtggtttgatgtgccgatgaccctgagcgaggcgcagagccaaaccatctatgacaccgttcgtgaactgcaaccgaactgcctgattaacagccgtctgggcaacggcaagtacgacttcgtgagcctgggcgataacgagatcccgaagaacaaagaagatatgaacaagaccgacgttgattacaacgagattaccggcttcaaaccgagcccgctgggcctgtatgaaaccgcgggtaccatcaacgacagctggggttttagctaccacgatcagaactggaagaccccgcgtaccctgtaccgttataaacaacacctgaacgactttggtattaactacctgctgaacgtgggcctggatccgctgggtcgtgttccgatgatggcggaggaaaacctgctggcggcgaaagcgctggaggacgaagcgaaccgttaa

SEQ ID NO: 34 - protein, 923 aa, Artificial Sequence
  SYNTHETIC FUSION PROTEN
MGSSHHHHHHSSGLVPRGSHMGTLQGSKDKSYDLIDEKDFPDKALREAVMAQVGTRKGDLERFNGTLRLDNPAIQSLEGLNKFKKLAQLDLIGLSRITKLDRSVLPANMKPGKDTLETVLETYKKDNKEEPATIPPVSLKVSGLTGLKELDLSGFDRETLAGLDAATLTSLEKVDISGNKLDLAPGTENRQIFDTMLSTISNHVGSNEQTVKFDKQKPTGHYPDTYGKTSLRLPVANEKVDLQSQLLFGTVTNQGTLINSEADYKAYQNHKIAGRSFVDSNYHYNNFKVSYENYTVKVTDSTLGTTTDKTLATDKEETYKVDFFSPADKTKAVHTAKVIVGDEKTMMVNLAEGATVIGGSADPVNARKVFDGQLGSETDNISLGWDSKQSIIFKLKEDGLIKHWRFFNDSARNPETTNKPIQEASLQIFNIKDYNLDNLLENPNKFDDEKYWITVDTYSAQGERATAFSNTLNNITSKYWRVVFDTKGDRYSSPVVPELQILGYPLPNADTIMKTVTTAKELSQQKDKFSQKMLDELKIKEMALETSLNSKIFDVTAINANAGVLKDCIEKRQLLKKGGANDNVAWFKQAKYGMMIHWGLYSLLAGEYRGESSSAYAEWIQSKFQIPNAEYGNLATAFNPLYFDAKKIVALAKQCGMQYLVVTTKHHDGFAMYHSKVDAYNVYDATPFHRDIIGELAEACQKAGLKFGLYYSQDLDWHDPNGGGYKSNDVETAGTTWDNSWDFPDEDQKNFDLCFDNKILPQIKEIMSNYGDIATAWFDVPMTLSEAQSQTIYDTVRELQPNCLINSRLGNGKYDFVSLGDNEIPKNKEDMNKTDVDYNEITGFKPSPLGLYETAGTINDSWGFSYHDQNWKTPRTLYRYKQHLNDFGINYLLNVGLDPLGRVPMMAEENLLAAKALEDEANR

SEQ ID NO: 35 - DNA, 2499 bp, Artificial Sequence
  SYNTHETIC FUSION PROTEN
atgggcagcagccatcatcatcatcatcacagcagcggcctggtgccgcgcggcagccatatgggtaccctgcagggatccaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggatggcggtgcaaacgacaacgtggcgtggttcaagcaggcgaaatatggcatgatgattcactggggtctgtacagcctgctggcgggcgagtatcgtggtgaaagcagcagcgcgtacgcggagtggatccagagcaagtttcaaattccgaacgcggaatacggcaacctggcgaccgcgttcaacccgctgtattttgatgcgaagaaaatcgttgcgctggcgaaacagtgcggcatgcaatacctggtggttaccaccaagcaccacgacggtttcgcgatgtatcacagcaaagtggacgcgtacaacgtttatgatgcgaccccgtttcaccgtgatatcattggcgagctggcggaagcgtgccagaaggcgggtctgaaattcggtctgtactatagccaagacctggattggcacgacccgaacggtggcggttataagagcaacgatgtggagaccgcgggtaccacctgggacaacagctgggatttcccggacgaagatcagaaaaacttcgacctgtgctttgataacaagatcctgccgcaaatcaaagagattatgagcaactacggtgacattgcgaccgcgtggtttgatgtgccgatgaccctgagcgaggcgcagagccaaaccatctatgacaccgttcgtgaactgcaaccgaactgcctgattaacagccgtctgggcaacggcaagtacgacttcgtgagcctgggcgataacgagatcccgaagaacaaagaagatatgaacaagaccgacgttgattacaacgagattaccggcttcaaaccgagcccgctgggcctgtatgaaaccgcgggtaccatcaacgacagctggggttttagctaccacgatcagaactggaagaccccgcgtaccctgtaccgttataaacaacacctgaacgactttggtattaactacctgctgaacgtgggcctggatccgctgggtcgtgttccgatgatggcggaggaaaacctgctggcggcgaaagcgctggaggacgaagcgaaccgttaa

SEQ ID NO: 36 - protein, 832 aa, Artificial Sequence
  SYNTHETIC FUSION PROTEN
MGSSHHHHHHSSGLVPRGSHMGTLQGSTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKDGGANDNVAWFKQAKYGMMIHWGLYSLLAGEYRGESSSAYAEWIQSKFQIPNAEYGNLATAFNPLYFDAKKIVALAKQCGMQYLVVTTKHHDGFAMYHSKVDAYNVYDATPFHRDIIGELAEACQKAGLKFGLYYSQDLDWHDPNGGGYKSNDVETAGTTWDNSWDFPDEDQKNFDLCFDNKILPQIKEIMSNYGDIATAWFDVPMTLSEAQSQTIYDTVRELQPNCLINSRLGNGKYDFVSLGDNEIPKNKEDMNKTDVDYNEITGFKPSPLGLYETAGTINDSWGFSYHDQNWKTPRTLYRYKQHLNDFGINYLLNVGLDPLGRVPMMAEENLLAAKALEDEANR

SEQ ID NO: 37 - DNA, 4047 bp, Artificial Sequence
  SYNTHETIC FUSION PROTEN
atgggcagcagccatcatcatcatcatcacagcagcggcctggtgccgcgcggcagccatatgacccaccatgattcactcaatactgtaaaagcggaggagaagactgttcaggttcagaaaggattaccttctatcgatagcttgcattatctgtcagagaatagcaaaaaagaatttaaagaagaactctcaaaagcggggcaagaatctcaaaaggtcaaagagatattagcaaaagctcagcaggcagataaacaagctcaagaacttgccaaaatgaaaattcctgagaaaataccgatgaaaccgttacatggttctctctacggtggttactttagaacttggcatgacaaaacatcagatccaacagaaaaagacaaagttaactcgatgggagagcttcctaaagaagtagatctagcctttattttccacgattggacaaaagattatagccttttttggaaagaattggccaccaaacatgtgccaaagttaaacaagcaagggacacgtgtcattcgtaccattccatggcgtttcctagctgggggtgataacagtggtattgcagaagataccagtaaatacccaaatacaccagagggaaataaagctttagccaaagctattgttgatgaatatgtttataaatacaaccttgatggcttagatgtggatgttgaacatgatagtattccaaaagttgacaaaaaagaagatacagcaggcgtagaacgctctattcaagtgtttgaagaaattgggaaattaattggaccaaaaggtgttgataaatcgcggttatttattatggatagcacctacatggctgataaaaacccattgattgagcgaggagctccttatattaatttattactggtacaggtctatggttcacaaggagagaaaggtggttgggagcctgtttctaatcgacctgaaaaaacaatggaagaacgatggcaaggttatagcaagtatattcgtcctgaacaatacatgattggtttttctttctatgaggaaaatgctcaagaagggaatctttggtatgatattaattctcgcaaggacgaggacaaagcaaatggaattaacactgacataactggaacgcgtgccgaacggtatgcaaggtggcaacctaagacaggtggggttaagggaggtatcttctcctacgctattgaccgagatggtgtagctcatcaacctaaaaaatatgctaaacagaaagagtttaaggacgcaactgataacatcttccactcagattatagtgtctccaaggcattaaagacagttatgctaaaagataagtcgtatgatctgattgatgagaaagatttcccagataaggctttgcgagaagctgtgatggcgcaggttggaaccagaaaaggtgatttggaacgtttcaatggcacattacgattggataatccagcgattcaaagtttagaaggtctaaataaatttaaaaaattagctcaattagacttgattggcttatctcgcattacaaagctcgaccgttctgttttacccgctaatatgaagccaggcaaagataccttggaaacagttcttgaaacctataaaaaggataacaaagaagaacctgctactatcccaccagtatctttgaaggtttctggtttaactggtctgaaagaattagatttgtcaggttttgaccgtgaaaccttggctggtcttgatgccgctactctaacgtctttagaaaaagttgatatttctggcaacaaacttgatttggctccaggaacagaaaatcgacaaatttttgatactatgctatcaactatcagcaatcatgttggaagcaatgaacaaacagtgaaatttgacaagcaaaaaccaactgggcattacccagatacctatgggaaaactagtctgcgcttaccagtggcaaatgaaaaagttgatttgcaaagccagcttttgtttgggactgtgacaaatcaaggaaccctaatcaatagcgaagcagactataaggcttaccaaaatcataaaattgctggacgtagctttgttgattcaaactatcattacaataactttaaagtttcttatgagaactataccgttaaagtaactgattccacattgggaaccactactgacaaaacgctagcaactgataaagaagagacctataaggttgacttctttagcccagcagataagacaaaagctgttcatactgctaaagtgattgttggtgacgaaaaaaccatgatggttaatttggcagaaggcgcaacagttattggaggaagtgctgatcctgtaaatgcaagaaaggtatttgatgggcaactgggcagtgagactgataatatctctttaggatgggattctaagcaaagtattatatttaaattgaaagaagatggattaataaagcattggcgtttcttcaatgattcagcccgaaatcctgagacaaccaataaacctattcaggaagcaagtctacaaatttttaatatcaaagattataatctagataatttgttggaaaatcccaataaatttgatgatgaaaaatattggattactgtagatacttacagtgcacaaggagagagagctactgcattcagtaatacattaaataatattactagtaaatattggcgagttgtctttgatactaaaggagatagatatagttcgccagtagtccctgaactccaaattttaggttatccgttacctaacgccgacactatcatgaaaacagtaactactgctaaagagttatctcaacaaaaagataagttttctcaaaagatgcttgatgagttaaaaataaaagagatggctttagaaacttctttgaacagtaagatttttgatgtaactgctattaatgctaatgctggagttttgaaagattgtattgagaaaaggcagctgctaaaaaaaggatccggtgctaacgacaacgtggcgtggttcaagcaggcgaaatatggcatgatgattcactggggtctgtacagcctgctggcgggcgagtatcgtggtgaaagcagcagcgcgtacgcggagtggatccagagcaagtttcaaattccgaacgcggaatacggcaacctggcgaccgcgttcaacccgctgtattttgatgcgaagaaaatcgttgcgctggcgaaacagtgcggcatgcaatacctggtggttaccaccaagcaccacgacggtttcgcgatgtatcacagcaaagtggacgcgtacaacgtttatgatgcgaccccgtttcaccgtgatatcattggcgagctggcggaagcgtgccagaaggcgggtctgaaattcggtctgtactatagccaagacctggattggcacgacccgaacggtggcggttataagagcaacgatgtggagaccgcgggtaccacctgggacaacagctgggatttcccggacgaagatcagaaaaacttcgacctgtgctttgataacaagatcctgccgcaaatcaaagagattatgagcaactacggtgacattgcgaccgcgtggtttgatgtgccgatgaccctgagcgaggcgcagagccaaaccatctatgacaccgttcgtgaactgcaaccgaactgcctgattaacagccgtctgggcaacggcaagtacgacttcgtgagcctgggcgataacgagatcccgaagaacaaagaagatatgaacaagaccgacgttgattacaacgagattaccggcttcaaaccgagcccgctgggcctgtatgaaaccgcgggtaccatcaacgacagctggggttttagctaccacgatcagaactggaagaccccgcgtaccctgtaccgttataaacaacacctgaacgactttggtattaactacctgctgaacgtgggcctggatccgctgggtcgtgttccgatgatggcggaggaaaacctgctggcggcgaaagcgctggaggacgaagcgaaccgtggtacctggtctcatccgcagttcgagaaataa

SEQ ID NO: 38 - protein, 1348 aa, Artificial Sequence
  SYNTHETIC FUSION PROTEN
MGSSHHHHHHSSGLVPRGSHMTHHDSLNTVKAEEKTVQVQKGLPSIDSLHYLSENSKKEFKEELSKAGQESQKVKEILAKAQQADKQAQELAKMKIPEKIPMKPLHGSLYGGYFRTWHDKTSDPTEKDKVNSMGELPKEVDLAFIFHDWTKDYSLFWKELATKHVPKLNKQGTRVIRTIPWRFLAGGDNSGIAEDTSKYPNTPEGNKALAKAIVDEYVYKYNLDGLDVDVEHDSIPKVDKKEDTAGVERSIQVFEEIGKLIGPKGVDKSRLFIMDSTYMADKNPLIERGAPYINLLLVQVYGSQGEKGGWEPVSNRPEKTMEERWQGYSKYIRPEQYMIGFSFYEENAQEGNLWYDINSRKDEDKANGINTDITGTRAERYARWQPKTGGVKGGIFSYAIDRDGVAHQPKKYAKQKEFKDATDNIFHSDYSVSKALKTVMLKDKSYDLIDEKDFPDKALREAVMAQVGTRKGDLERFNGTLRLDNPAIQSLEGLNKFKKLAQLDLIGLSRITKLDRSVLPANMKPGKDTLETVLETYKKDNKEEPATIPPVSLKVSGLTGLKELDLSGFDRETLAGLDAATLTSLEKVDISGNKLDLAPGTENRQIFDTMLSTISNHVGSNEQTVKFDKQKPTGHYPDTYGKTSLRLPVANEKVDLQSQLLFGTVTNQGTLINSEADYKAYQNHKIAGRSFVDSNYHYNNFKVSYENYTVKVTDSTLGTTTDKTLATDKEETYKVDFFSPADKTKAVHTAKVIVGDEKTMMVNLAEGATVIGGSADPVNARKVFDGQLGSETDNISLGWDSKQSIIFKLKEDGLIKHWRFFNDSARNPETTNKPIQEASLQIFNIKDYNLDNLLENPNKFDDEKYWITVDTYSAQGERATAFSNTLNNITSKYWRVVFDTKGDRYSSPVVPELQILGYPLPNADTIMKTVTTAKELSQQKDKFSQKMLDELKIKEMALETSLNSKIFDVTAINANAGVLKDCIEKRQLLKKGSGANDNVAWFKQAKYGMMIHWGLYSLLAGEYRGESSSAYAEWIQSKFQIPNAEYGNLATAFNPLYFDAKKIVALAKQCGMQYLVVTTKHHDGFAMYHSKVDAYNVYDATPFHRDIIGELAEACQKAGLKFGLYYSQDLDWHDPNGGGYKSNDVETAGTTWDNSWDFPDEDQKNFDLCFDNKILPQIKEIMSNYGDIATAWFDVPMTLSEAQSQTIYDTVRELQPNCLINSRLGNGKYDFVSLGDNEIPKNKEDMNKTDVDYNEITGFKPSPLGLYETAGTINDSWGFSYHDQNWKTPRTLYRYKQHLNDFGINYLLNVGLDPLGRVPMMAEENLLAAKALEDEANRGTWSHPQFEK

SEQ ID NO: 39 - DNA, 4047 bp, Artificial Sequence
  SYNTHETIC FUSION PROTEN
atgggcagcagccatcatcatcatcatcacagcagcggcctggtgccgcgcggcagccatatgacccaccatgattcactcaatactgtaaaagcggaggagaagactgttcaggttcagaaaggattaccttctatcgatagcttgcattatctgtcagagaatagcaaaaaagaatttaaagaagaactctcaaaagcggggcaagaatctcaaaaggtcaaagagatattagcaaaagctcagcaggcagataaacaagctcaagaacttgccaaaatgaaaattcctgagaaaataccgatgaaaccgttacatggttctctctacggtggttactttagaacttggcatgacaaaacatcagatccaacagaaaaagacaaagttaactcgatgggagagcttcctaaagaagtagatctagcctttattttccacgattggacaaaagattatagccttttttggaaagaattggccaccaaacatgtgccaaagttaaacaagcaagggacacgtgtcattcgtaccattccatggcgtttcctagctgggggtgataacagtggtattgcagaagataccagtaaatacccaaatacaccagagggaaataaagctttagccaaagctattgttgatgaatatgtttataaatacaaccttgatggcttagatgtgcaggttgaacatgatagtattccaaaagttgacaaaaaagaagatacagcaggcgtagaacgctctattcaagtgtttgaagaaattgggaaattaattggaccaaaaggtgttgataaatcgcggttatttattatggatagcacctacatggctgataaaaacccattgattgagcgaggagctccttatattaatttattactggtacaggtctatggttcacaaggagagaaaggtggttgggagcctgtttctaatcgacctgaaaaaacaatggaagaacgatggcaaggttatagcaagtatattcgtcctgaacaatacatgattggtttttctttctatgaggaaaatgctcaagaagggaatctttggtatgatattaattctcgcaaggacgaggacaaagcaaatggaattaacactgacataactggaacgcgtgccgaacggtatgcaaggtggcaacctaagacaggtggggttaagggaggtatcttctcctacgctattgaccgagatggtgtagctcatcaacctaaaaaatatgctaaacagaaagagtttaaggacgcaactgataacatcttccactcagattatagtgtctccaaggcattaaagacagttatgctaaaagataagtcgtatgatctgattgatgagaaagatttcccagataaggctttgcgagaagctgtgatggcgcaggttggaaccagaaaaggtgatttggaacgtttcaatggcacattacgattggataatccagcgattcaaagtttagaaggtctaaataaatttaaaaaattagctcaattagacttgattggcttatctcgcattacaaagctcgaccgttctgttttacccgctaatatgaagccaggcaaagataccttggaaacagttcttgaaacctataaaaaggataacaaagaagaacctgctactatcccaccagtatctttgaaggtttctggtttaactggtctgaaagaattagatttgtcaggttttgaccgtgaaaccttggctggtcttgatgccgctactctaacgtctttagaaaaagttgatatttctggcaacaaacttgatttggctccaggaacagaaaatcgacaaatttttgatactatgctatcaactatcagcaatcatgttggaagcaatgaacaaacagtgaaatttgacaagcaaaaaccaactgggcattacccagatacctatgggaaaactagtctgcgcttaccagtggcaaatgaaaaagttgatttgcaaagccagcttttgtttgggactgtgacaaatcaaggaaccctaatcaatagcgaagcagactataaggcttaccaaaatcataaaattgctggacgtagctttgttgattcaaactatcattacaataactttaaagtttcttatgagaactataccgttaaagtaactgattccacattgggaaccactactgacaaaacgctagcaactgataaagaagagacctataaggttgacttctttagcccagcagataagacaaaagctgttcatactgctaaagtgattgttggtgacgaaaaaaccatgatggttaatttggcagaaggcgcaacagttattggaggaagtgctgatcctgtaaatgcaagaaaggtatttgatgggcaactgggcagtgagactgataatatctctttaggatgggattctaagcaaagtattatatttaaattgaaagaagatggattaataaagcattggcgtttcttcaatgattcagcccgaaatcctgagacaaccaataaacctattcaggaagcaagtctacaaatttttaatatcaaagattataatctagataatttgttggaaaatcccaataaatttgatgatgaaaaatattggattactgtagatacttacagtgcacaaggagagagagctactgcattcagtaatacattaaataatattactagtaaatattggcgagttgtctttgatactaaaggagatagatatagttcgccagtagtccctgaactccaaattttaggttatccgttacctaacgccgacactatcatgaaaacagtaactactgctaaagagttatctcaacaaaaagataagttttctcaaaagatgcttgatgagttaaaaataaaagagatggctttagaaacttctttgaacagtaagatttttgatgtaactgctattaatgctaatgctggagttttgaaagattgtattgagaaaaggcagctgctaaaaaaaggatccggtgctaacgacaacgtggcgtggttcaagcaggcgaaatatggcatgatgattcactggggtctgtacagcctgctggcgggcgagtatcgtggtgaaagcagcagcgcgtacgcggagtggatccagagcaagtttcaaattccgaacgcggaatacggcaacctggcgaccgcgttcaacccgctgtattttgatgcgaagaaaatcgttgcgctggcgaaacagtgcggcatgcaatacctggtggttaccaccaagcaccacgacggtttcgcgatgtatcacagcaaagtggacgcgtacaacgtttatgatgcgaccccgtttcaccgtgatatcattggcgagctggcggaagcgtgccagaaggcgggtctgaaattcggtctgtactatagccaagacctggattggcacgacccgaacggtggcggttataagagcaacgatgtggagaccgcgggtaccacctgggacaacagctgggatttcccggacgaagatcagaaaaacttcgacctgtgctttgataacaagatcctgccgcaaatcaaagagattatgagcaactacggtgacattgcgaccgcgtggtttgatgtgccgatgaccctgagcgaggcgcagagccaaaccatctatgacaccgttcgtgaactgcaaccgaactgcctgattaacagccgtctgggcaacggcaagtacgacttcgtgagcctgggcgataacgagatcccgaagaacaaagaagatatgaacaagaccgacgttgattacaacgagattaccggcttcaaaccgagcccgctgggcctgtatgaaaccgcgggtaccatcaacgacagctggggttttagctaccacgatcagaactggaagaccccgcgtaccctgtaccgttataaacaacacctgaacgactttggtattaactacctgctgaacgtgggcctggatccgctgggtcgtgttccgatgatggcggaggaaaacctgctggcggcgaaagcgctggaggacgaagcgaaccgtggtacctggtctcatccgcagttcgagaaataa

SEQ ID NO: 40 - protein, 1348 aa, Artificial Sequence
  SYNTHETIC FUSION PROTEN
MGSSHHHHHHSSGLVPRGSHMTHHDSLNTVKAEEKTVQVQKGLPSIDSLHYLSENSKKEFKEELSKAGQESQKVKEILAKAQQADKQAQELAKMKIPEKIPMKPLHGSLYGGYFRTWHDKTSDPTEKDKVNSMGELPKEVDLAFIFHDWTKDYSLFWKELATKHVPKLNKQGTRVIRTIPWRFLAGGDNSGIAEDTSKYPNTPEGNKALAKAIVDEYVYKYNLDGLDVQVEHDSIPKVDKKEDTAGVERSIQVFEEIGKLIGPKGVDKSRLFIMDSTYMADKNPLIERGAPYINLLLVQVYGSQGEKGGWEPVSNRPEKTMEERWQGYSKYIRPEQYMIGFSFYEENAQEGNLWYDINSRKDEDKANGINTDITGTRAERYARWQPKTGGVKGGIFSYAIDRDGVAHQPKKYAKQKEFKDATDNIFHSDYSVSKALKTVMLKDKSYDLIDEKDFPDKALREAVMAQVGTRKGDLERFNGTLRLDNPAIQSLEGLNKFKKLAQLDLIGLSRITKLDRSVLPANMKPGKDTLETVLETYKKDNKEEPATIPPVSLKVSGLTGLKELDLSGFDRETLAGLDAATLTSLEKVDISGNKLDLAPGTENRQIFDTMLSTISNHVGSNEQTVKFDKQKPTGHYPDTYGKTSLRLPVANEKVDLQSQLLFGTVTNQGTLINSEADYKAYQNHKIAGRSFVDSNYHYNNFKVSYENYTVKVTDSTLGTTTDKTLATDKEETYKVDFFSPADKTKAVHTAKVIVGDEKTMMVNLAEGATVIGGSADPVNARKVFDGQLGSETDNISLGWDSKQSIIFKLKEDGLIKHWRFFNDSARNPETTNKPIQEASLQIFNIKDYNLDNLLENPNKFDDEKYWITVDTYSAQGERATAFSNTLNNITSKYWRVVFDTKGDRYSSPVVPELQILGYPLPNADTIMKTVTTAKELSQQKDKFSQKMLDELKIKEMALETSLNSKIFDVTAINANAGVLKDCIEKRQLLKKGSGANDNVAWFKQAKYGMMIHWGLYSLLAGEYRGESSSAYAEWIQSKFQIPNAEYGNLATAFNPLYFDAKKIVALAKQCGMQYLVVTTKHHDGFAMYHSKVDAYNVYDATPFHRDIIGELAEACQKAGLKFGLYYSQDLDWHDPNGGGYKSNDVETAGTTWDNSWDFPDEDQKNFDLCFDNKILPQIKEIMSNYGDIATAWFDVPMTLSEAQSQTIYDTVRELQPNCLINSRLGNGKYDFVSLGDNEIPKNKEDMNKTDVDYNEITGFKPSPLGLYETAGTINDSWGFSYHDQNWKTPRTLYRYKQHLNDFGINYLLNVGLDPLGRVPMMAEENLLAAKALEDEANRGTWSHPQFEK

SEQ ID NO: 41 - DNA, 3522 bp, Artificial Sequence
  SYNTHETIC FUSION PROTEN
atgggcagcagccatcatcaccatcaccatgagctccccggggaattcgaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcagacaattggtgttaacgaattaaatggacgtacaggtttatctaaagattatcctgatactcctgaggggaacaaagctttagcagcagccattgtcaaggcatttgtaactgatcgtggtgtcgatggactagatattgatattgagcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggatgcgatcgctcatatgaacgacaacgtggcgtggttcaagcaggcgaaatatggcatgatgattcactggggtctgtacagcctgctggcgggcgagtatcgtggtgaaagcagcagcgcgtacgcggagtggatccagagcaagtttcaaattccgaacgcggaatacggcaacctggcgaccgcgttcaacccgctgtattttgatgcgaagaaaatcgttgcgctggcgaaacagtgcggcatgcaatacctggtggttaccaccaagcaccacgacggtttcgcgatgtatcacagcaaagtggacgcgtacaacgtttatgatgcgaccccgtttcaccgtgatatcattggcgagctggcggaagcgtgccagaaggcgggtctgaaattcggtctgtactatagccaagacctggattggcacgacccgaacggtggcggttataagagcaacgatgtggagaccgcgggtaccacctgggacaacagctgggatttcccggacgaagatcagaaaaacttcgacctgtgctttgataacaagatcctgccgcaaatcaaagagattatgagcaactacggtgacattgcgaccgcgtggtttgatgtgccgatgaccctgagcgaggcgcagagccaaaccatctatgacaccgttcgtgaactgcaaccgaactgcctgattaacagccgtctgggcaacggcaagtacgacttcgtgagcctgggcgataacgagatcccgaagaacaaagaagatatgaacaagaccgacgttgattacaacgagattaccggcttcaaaccgagcccgctgggcctgtatgaaaccgcgggtaccatcaacgacagctggggttttagctaccacgatcagaactggaagaccccgcgtaccctgtaccgttataaacaacacctgaacgactttggtattaactacctgctgaacgtgggcctggatccgctgggtcgtgttccgatgatggcggaggaaaacctgctggcggcgaaagcgctggaggacgaagcgaaccgtgaattctaa

SEQ ID NO: 42 - protein, 1173 aa, Artificial Sequence
  SYNTHETIC FUSION PROTEN
MGSSHHHHHHELPGEFEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQTIGVNELNGRTGLSKDYPDTPEGNKALAAAIVKAFVTDRGVDGLDIDIEHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKDAIAHMNDNVAWFKQAKYGMMIHWGLYSLLAGEYRGESSSAYAEWIQSKFQIPNAEYGNLATAFNPLYFDAKKIVALAKQCGMQYLVVTTKHHDGFAMYHSKVDAYNVYDATPFHRDIIGELAEACQKAGLKFGLYYSQDLDWHDPNGGGYKSNDVETAGTTWDNSWDFPDEDQKNFDLCFDNKILPQIKEIMSNYGDIATAWFDVPMTLSEAQSQTIYDTVRELQPNCLINSRLGNGKYDFVSLGDNEIPKNKEDMNKTDVDYNEITGFKPSPLGLYETAGTINDSWGFSYHDQNWKTPRTLYRYKQHLNDFGINYLLNVGLDPLGRVPMMAEENLLAAKALEDEANREF

SEQ ID NO: 43 - DNA, 3522 bp, Artificial Sequence
  SYNTHETIC FUSION PROTEN
atgggcagcagccatcatcaccatcaccatgagctccccggggaattcgaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcaggaaattggtgttaacgaattaaatggacgtacaggtttatctaaagattatcctgatactcctgaggggaacaaagctttagcagcagccattgtcaaggcatttgtaactgatcgtggtgtcgatggactagatattgatattgagcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggatgcgatcgctcatatgaacgacaacgtggcgtggttcaagcaggcgaaatatggcatgatgattcactggggtctgtacagcctgctggcgggcgagtatcgtggtgaaagcagcagcgcgtacgcggagtggatccagagcaagtttcaaattccgaacgcggaatacggcaacctggcgaccgcgttcaacccgctgtattttgatgcgaagaaaatcgttgcgctggcgaaacagtgcggcatgcaatacctggtggttaccaccaagcaccacgacggtttcgcgatgtatcacagcaaagtggacgcgtacaacgtttatgatgcgaccccgtttcaccgtgatatcattggcgagctggcggaagcgtgccagaaggcgggtctgaaattcggtctgtactatagccaagacctggattggcacgacccgaacggtggcggttataagagcaacgatgtggagaccgcgggtaccacctgggacaacagctgggatttcccggacgaagatcagaaaaacttcgacctgtgctttgataacaagatcctgccgcaaatcaaagagattatgagcaactacggtgacattgcgaccgcgtggtttgatgtgccgatgaccctgagcgaggcgcagagccaaaccatctatgacaccgttcgtgaactgcaaccgaactgcctgattaacagccgtctgggcaacggcaagtacgacttcgtgagcctgggcgataacgagatcccgaagaacaaagaagatatgaacaagaccgacgttgattacaacgagattaccggcttcaaaccgagcccgctgggcctgtatgaaaccgcgggtaccatcaacgacagctggggttttagctaccacgatcagaactggaagaccccgcgtaccctgtaccgttataaacaacacctgaacgactttggtattaactacctgctgaacgtgggcctggatccgctgggtcgtgttccgatgatggcggaggaaaacctgctggcggcgaaagcgctggaggacgaagcgaaccgtgaattctaa

SEQ ID NO: 44 - protein, 1173 aa, Artificial Sequence
  SYNTHETIC FUSION PROTEN
MGSSHHHHHHELPGEFEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQEIGVNELNGRTGLSKDYPDTPEGNKALAAAIVKAFVTDRGVDGLDIDIEHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKDAIAHMNDNVAWFKQAKYGMMIHWGLYSLLAGEYRGESSSAYAEWIQSKFQIPNAEYGNLATAFNPLYFDAKKIVALAKQCGMQYLVVTTKHHDGFAMYHSKVDAYNVYDATPFHRDIIGELAEACQKAGLKFGLYYSQDLDWHDPNGGGYKSNDVETAGTTWDNSWDFPDEDQKNFDLCFDNKILPQIKEIMSNYGDIATAWFDVPMTLSEAQSQTIYDTVRELQPNCLINSRLGNGKYDFVSLGDNEIPKNKEDMNKTDVDYNEITGFKPSPLGLYETAGTINDSWGFSYHDQNWKTPRTLYRYKQHLNDFGINYLLNVGLDPLGRVPMMAEENLLAAKALEDEANREF

SEQ ID NO: 45 - DNA, 3522 bp, Artificial Sequence
  SYNTHETIC FUSION PROTEN
atgggcagcagccatcatcaccatcaccatgagctccccggggaattcgaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcagcagattggtgttaacgaattaaatggacgtacaggtttatctaaagattatcctgatactcctgaggggaacaaagctttagcagcagccattgtcaaggcatttgtaactgatcgtggtgtcgatggactagatattgatattgagcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggatgcgatcgctcatatgaacgacaacgtggcgtggttcaagcaggcgaaatatggcatgatgattcactggggtctgtacagcctgctggcgggcgagtatcgtggtgaaagcagcagcgcgtacgcggagtggatccagagcaagtttcaaattccgaacgcggaatacggcaacctggcgaccgcgttcaacccgctgtattttgatgcgaagaaaatcgttgcgctggcgaaacagtgcggcatgcaatacctggtggttaccaccaagcaccacgacggtttcgcgatgtatcacagcaaagtggacgcgtacaacgtttatgatgcgaccccgtttcaccgtgatatcattggcgagctggcggaagcgtgccagaaggcgggtctgaaattcggtctgtactatagccaagacctggattggcacgacccgaacggtggcggttataagagcaacgatgtggagaccgcgggtaccacctgggacaacagctgggatttcccggacgaagatcagaaaaacttcgacctgtgctttgataacaagatcctgccgcaaatcaaagagattatgagcaactacggtgacattgcgaccgcgtggtttgatgtgccgatgaccctgagcgaggcgcagagccaaaccatctatgacaccgttcgtgaactgcaaccgaactgcctgattaacagccgtctgggcaacggcaagtacgacttcgtgagcctgggcgataacgagatcccgaagaacaaagaagatatgaacaagaccgacgttgattacaacgagattaccggcttcaaaccgagcccgctgggcctgtatgaaaccgcgggtaccatcaacgacagctggggttttagctaccacgatcagaactggaagaccccgcgtaccctgtaccgttataaacaacacctgaacgactttggtattaactacctgctgaacgtgggcctggatccgctgggtcgtgttccgatgatggcggaggaaaacctgctggcggcgaaagcgctggaggacgaagcgaaccgtgaattctaa

SEQ ID NO: 46 - protein, 1173 aa, Artificial Sequence
  SYNTHETIC FUSION PROTEN
MGSSHHHHHHELPGEFEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQQIGVNELNGRTGLSKDYPDTPEGNKALAAAIVKAFVTDRGVDGLDIDIEHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKDAIAHMNDNVAWFKQAKYGMMIHWGLYSLLAGEYRGESSSAYAEWIQSKFQIPNAEYGNLATAFNPLYFDAKKIVALAKQCGMQYLVVTTKHHDGFAMYHSKVDAYNVYDATPFHRDIIGELAEACQKAGLKFGLYYSQDLDWHDPNGGGYKSNDVETAGTTWDNSWDFPDEDQKNFDLCFDNKILPQIKEIMSNYGDIATAWFDVPMTLSEAQSQTIYDTVRELQPNCLINSRLGNGKYDFVSLGDNEIPKNKEDMNKTDVDYNEITGFKPSPLGLYETAGTINDSWGFSYHDQNWKTPRTLYRYKQHLNDFGINYLLNVGLDPLGRVPMMAEENLLAAKALEDEANREF

SEQ ID NO: 47 - DNA, 3522 bp, Artificial Sequence
  SYNTHETIC FUSION PROTEN
atgggcagcagccatcatcaccatcaccatgagctccccggggaattcgaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcagcggattggtgttaacgaattaaatggacgtacaggtttatctaaagattatcctgatactcctgaggggaacaaagctttagcagcagccattgtcaaggcatttgtaactgatcgtggtgtcgatggactagatattgatattgagcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggatgcgatcgctcatatgaacgacaacgtggcgtggttcaagcaggcgaaatatggcatgatgattcactggggtctgtacagcctgctggcgggcgagtatcgtggtgaaagcagcagcgcgtacgcggagtggatccagagcaagtttcaaattccgaacgcggaatacggcaacctggcgaccgcgttcaacccgctgtattttgatgcgaagaaaatcgttgcgctggcgaaacagtgcggcatgcaatacctggtggttaccaccaagcaccacgacggtttcgcgatgtatcacagcaaagtggacgcgtacaacgtttatgatgcgaccccgtttcaccgtgatatcattggcgagctggcggaagcgtgccagaaggcgggtctgaaattcggtctgtactatagccaagacctggattggcacgacccgaacggtggcggttataagagcaacgatgtggagaccgcgggtaccacctgggacaacagctgggatttcccggacgaagatcagaaaaacttcgacctgtgctttgataacaagatcctgccgcaaatcaaagagattatgagcaactacggtgacattgcgaccgcgtggtttgatgtgccgatgaccctgagcgaggcgcagagccaaaccatctatgacaccgttcgtgaactgcaaccgaactgcctgattaacagccgtctgggcaacggcaagtacgacttcgtgagcctgggcgataacgagatcccgaagaacaaagaagatatgaacaagaccgacgttgattacaacgagattaccggcttcaaaccgagcccgctgggcctgtatgaaaccgcgggtaccatcaacgacagctggggttttagctaccacgatcagaactggaagaccccgcgtaccctgtaccgttataaacaacacctgaacgactttggtattaactacctgctgaacgtgggcctggatccgctgggtcgtgttccgatgatggcggaggaaaacctgctggcggcgaaagcgctggaggacgaagcgaaccgtgaattctaa

SEQ ID NO: 48 - protein, 1173 aa, Artificial Sequence
  SYNTHETIC FUSION PROTEN
MGSSHHHHHHELPGEFEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQRIGVNELNGRTGLSKDYPDTPEGNKALAAAIVKAFVTDRGVDGLDIDIEHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKDAIAHMNDNVAWFKQAKYGMMIHWGLYSLLAGEYRGESSSAYAEWIQSKFQIPNAEYGNLATAFNPLYFDAKKIVALAKQCGMQYLVVTTKHHDGFAMYHSKVDAYNVYDATPFHRDIIGELAEACQKAGLKFGLYYSQDLDWHDPNGGGYKSNDVETAGTTWDNSWDFPDEDQKNFDLCFDNKILPQIKEIMSNYGDIATAWFDVPMTLSEAQSQTIYDTVRELQPNCLINSRLGNGKYDFVSLGDNEIPKNKEDMNKTDVDYNEITGFKPSPLGLYETAGTINDSWGFSYHDQNWKTPRTLYRYKQHLNDFGINYLLNVGLDPLGRVPMMAEENLLAAKALEDEANREF

SEQ ID NO: 49 - DNA, 3522 bp, Artificial Sequence
  SYNTHETIC FUSION PROTEN
atgggcagcagccatcatcaccatcaccatgagctccccggggaattcgaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcagatgattggtgttaacgaattaaatggacgtacaggtttatctaaagattatcctgatactcctgaggggaacaaagctttagcagcagccattgtcaaggcatttgtaactgatcgtggtgtcgatggactagatattgatattgagcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggatgcgatcgctcatatgaacgacaacgtggcgtggttcaagcaggcgaaatatggcatgatgattcactggggtctgtacagcctgctggcgggcgagtatcgtggtgaaagcagcagcgcgtacgcggagtggatccagagcaagtttcaaattccgaacgcggaatacggcaacctggcgaccgcgttcaacccgctgtattttgatgcgaagaaaatcgttgcgctggcgaaacagtgcggcatgcaatacctggtggttaccaccaagcaccacgacggtttcgcgatgtatcacagcaaagtggacgcgtacaacgtttatgatgcgaccccgtttcaccgtgatatcattggcgagctggcggaagcgtgccagaaggcgggtctgaaattcggtctgtactatagccaagacctggattggcacgacccgaacggtggcggttataagagcaacgatgtggagaccgcgggtaccacctgggacaacagctgggatttcccggacgaagatcagaaaaacttcgacctgtgctttgataacaagatcctgccgcaaatcaaagagattatgagcaactacggtgacattgcgaccgcgtggtttgatgtgccgatgaccctgagcgaggcgcagagccaaaccatctatgacaccgttcgtgaactgcaaccgaactgcctgattaacagccgtctgggcaacggcaagtacgacttcgtgagcctgggcgataacgagatcccgaagaacaaagaagatatgaacaagaccgacgttgattacaacgagattaccggcttcaaaccgagcccgctgggcctgtatgaaaccgcgggtaccatcaacgacagctggggttttagctaccacgatcagaactggaagaccccgcgtaccctgtaccgttataaacaacacctgaacgactttggtattaactacctgctgaacgtgggcctggatccgctgggtcgtgttccgatgatggcggaggaaaacctgctggcggcgaaagcgctggaggacgaagcgaaccgtgaattctaa

SEQ ID NO: 50 - protein, 1173 aa, Artificial Sequence
  SYNTHETIC FUSION PROTEN
MGSSHHHHHHELPGEFEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQMIGVNELNGRTGLSKDYPDTPEGNKALAAAIVKAFVTDRGVDGLDIDIEHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKDAIAHMNDNVAWFKQAKYGMMIHWGLYSLLAGEYRGESSSAYAEWIQSKFQIPNAEYGNLATAFNPLYFDAKKIVALAKQCGMQYLVVTTKHHDGFAMYHSKVDAYNVYDATPFHRDIIGELAEACQKAGLKFGLYYSQDLDWHDPNGGGYKSNDVETAGTTWDNSWDFPDEDQKNFDLCFDNKILPQIKEIMSNYGDIATAWFDVPMTLSEAQSQTIYDTVRELQPNCLINSRLGNGKYDFVSLGDNEIPKNKEDMNKTDVDYNEITGFKPSPLGLYETAGTINDSWGFSYHDQNWKTPRTLYRYKQHLNDFGINYLLNVGLDPLGRVPMMAEENLLAAKALEDEANREF

SEQ ID NO: 51 - DNA, 3522 bp, Artificial Sequence
  SYNTHETIC FUSION PROTEN
atgggcagcagccatcatcaccatcaccatgagctccccggggaattcgaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcagctgattggtgttaacgaattaaatggacgtacaggtttatctaaagattatcctgatactcctgaggggaacaaagctttagcagcagccattgtcaaggcatttgtaactgatcgtggtgtcgatggactagatattgatattgagcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggatgcgatcgctcatatgaacgacaacgtggcgtggttcaagcaggcgaaatatggcatgatgattcactggggtctgtacagcctgctggcgggcgagtatcgtggtgaaagcagcagcgcgtacgcggagtggatccagagcaagtttcaaattccgaacgcggaatacggcaacctggcgaccgcgttcaacccgctgtattttgatgcgaagaaaatcgttgcgctggcgaaacagtgcggcatgcaatacctggtggttaccaccaagcaccacgacggtttcgcgatgtatcacagcaaagtggacgcgtacaacgtttatgatgcgaccccgtttcaccgtgatatcattggcgagctggcggaagcgtgccagaaggcgggtctgaaattcggtctgtactatagccaagacctggattggcacgacccgaacggtggcggttataagagcaacgatgtggagaccgcgggtaccacctgggacaacagctgggatttcccggacgaagatcagaaaaacttcgacctgtgctttgataacaagatcctgccgcaaatcaaagagattatgagcaactacggtgacattgcgaccgcgtggtttgatgtgccgatgaccctgagcgaggcgcagagccaaaccatctatgacaccgttcgtgaactgcaaccgaactgcctgattaacagccgtctgggcaacggcaagtacgacttcgtgagcctgggcgataacgagatcccgaagaacaaagaagatatgaacaagaccgacgttgattacaacgagattaccggcttcaaaccgagcccgctgggcctgtatgaaaccgcgggtaccatcaacgacagctggggttttagctaccacgatcagaactggaagaccccgcgtaccctgtaccgttataaacaacacctgaacgactttggtattaactacctgctgaacgtgggcctggatccgctgggtcgtgttccgatgatggcggaggaaaacctgctggcggcgaaagcgctggaggacgaagcgaaccgtgaattctaa

SEQ ID NO: 52 - protein, 1173 aa, Artificial Sequence
  SYNTHETIC FUSION PROTEN
MGSSHHHHHHELPGEFEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQLIGVNELNGRTGLSKDYPDTPEGNKALAAAIVKAFVTDRGVDGLDIDIEHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKDAIAHMNDNVAWFKQAKYGMMIHWGLYSLLAGEYRGESSSAYAEWIQSKFQIPNAEYGNLATAFNPLYFDAKKIVALAKQCGMQYLVVTTKHHDGFAMYHSKVDAYNVYDATPFHRDIIGELAEACQKAGLKFGLYYSQDLDWHDPNGGGYKSNDVETAGTTWDNSWDFPDEDQKNFDLCFDNKILPQIKEIMSNYGDIATAWFDVPMTLSEAQSQTIYDTVRELQPNCLINSRLGNGKYDFVSLGDNEIPKNKEDMNKTDVDYNEITGFKPSPLGLYETAGTINDSWGFSYHDQNWKTPRTLYRYKQHLNDFGINYLLNVGLDPLGRVPMMAEENLLAAKALEDEANREF

SEQ ID NO: 53 - DNA, 3522 bp, Artificial Sequence
  SYNTHETIC FUSION PROTEN
atgggcagcagccatcatcaccatcaccatgagctccccggggaattcgaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcagcacattggtgttaacgaattaaatggacgtacaggtttatctaaagattatcctgatactcctgaggggaacaaagctttagcagcagccattgtcaaggcatttgtaactgatcgtggtgtcgatggactagatattgatattgagcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggatgcgatcgctcatatgaacgacaacgtggcgtggttcaagcaggcgaaatatggcatgatgattcactggggtctgtacagcctgctggcgggcgagtatcgtggtgaaagcagcagcgcgtacgcggagtggatccagagcaagtttcaaattccgaacgcggaatacggcaacctggcgaccgcgttcaacccgctgtattttgatgcgaagaaaatcgttgcgctggcgaaacagtgcggcatgcaatacctggtggttaccaccaagcaccacgacggtttcgcgatgtatcacagcaaagtggacgcgtacaacgtttatgatgcgaccccgtttcaccgtgatatcattggcgagctggcggaagcgtgccagaaggcgggtctgaaattcggtctgtactatagccaagacctggattggcacgacccgaacggtggcggttataagagcaacgatgtggagaccgcgggtaccacctgggacaacagctgggatttcccggacgaagatcagaaaaacttcgacctgtgctttgataacaagatcctgccgcaaatcaaagagattatgagcaactacggtgacattgcgaccgcgtggtttgatgtgccgatgaccctgagcgaggcgcagagccaaaccatctatgacaccgttcgtgaactgcaaccgaactgcctgattaacagccgtctgggcaacggcaagtacgacttcgtgagcctgggcgataacgagatcccgaagaacaaagaagatatgaacaagaccgacgttgattacaacgagattaccggcttcaaaccgagcccgctgggcctgtatgaaaccgcgggtaccatcaacgacagctggggttttagctaccacgatcagaactggaagaccccgcgtaccctgtaccgttataaacaacacctgaacgactttggtattaactacctgctgaacgtgggcctggatccgctgggtcgtgttccgatgatggcggaggaaaacctgctggcggcgaaagcgctggaggacgaagcgaaccgtgaattctaa

SEQ ID NO: 54 - protein, 1173 aa, Artificial Sequence
  SYNTHETIC FUSION PROTEN
MGSSHHHHHHELPGEFEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQHIGVNELNGRTGLSKDYPDTPEGNKALAAAIVKAFVTDRGVDGLDIDIEHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKDAIAHMNDNVAWFKQAKYGMMIHWGLYSLLAGEYRGESSSAYAEWIQSKFQIPNAEYGNLATAFNPLYFDAKKIVALAKQCGMQYLVVTTKHHDGFAMYHSKVDAYNVYDATPFHRDIIGELAEACQKAGLKFGLYYSQDLDWHDPNGGGYKSNDVETAGTTWDNSWDFPDEDQKNFDLCFDNKILPQIKEIMSNYGDIATAWFDVPMTLSEAQSQTIYDTVRELQPNCLINSRLGNGKYDFVSLGDNEIPKNKEDMNKTDVDYNEITGFKPSPLGLYETAGTINDSWGFSYHDQNWKTPRTLYRYKQHLNDFGINYLLNVGLDPLGRVPMMAEENLLAAKALEDEANREF

SEQ ID NO: 55 - DNA, 3522 bp, Artificial Sequence
  SYNTHETIC FUSION PROTEN
atgggcagcagccatcatcaccatcaccatgagctccccggggaattcgaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcagaacattggtgttaacgaattaaatggacgtacaggtttatctaaagattatcctgatactcctgaggggaacaaagctttagcagcagccattgtcaaggcatttgtaactgatcgtggtgtcgatggactagatattgatattgagcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggatgcgatcgctcatatgaacgacaacgtggcgtggttcaagcaggcgaaatatggcatgatgattcactggggtctgtacagcctgctggcgggcgagtatcgtggtgaaagcagcagcgcgtacgcggagtggatccagagcaagtttcaaattccgaacgcggaatacggcaacctggcgaccgcgttcaacccgctgtattttgatgcgaagaaaatcgttgcgctggcgaaacagtgcggcatgcaatacctggtggttaccaccaagcaccacgacggtttcgcgatgtatcacagcaaagtggacgcgtacaacgtttatgatgcgaccccgtttcaccgtgatatcattggcgagctggcggaagcgtgccagaaggcgggtctgaaattcggtctgtactatagccaagacctggattggcacgacccgaacggtggcggttataagagcaacgatgtggagaccgcgggtaccacctgggacaacagctgggatttcccggacgaagatcagaaaaacttcgacctgtgctttgataacaagatcctgccgcaaatcaaagagattatgagcaactacggtgacattgcgaccgcgtggtttgatgtgccgatgaccctgagcgaggcgcagagccaaaccatctatgacaccgttcgtgaactgcaaccgaactgcctgattaacagccgtctgggcaacggcaagtacgacttcgtgagcctgggcgataacgagatcccgaagaacaaagaagatatgaacaagaccgacgttgattacaacgagattaccggcttcaaaccgagcccgctgggcctgtatgaaaccgcgggtaccatcaacgacagctggggttttagctaccacgatcagaactggaagaccccgcgtaccctgtaccgttataaacaacacctgaacgactttggtattaactacctgctgaacgtgggcctggatccgctgggtcgtgttccgatgatggcggaggaaaacctgctggcggcgaaagcgctggaggacgaagcgaaccgtgaattctaa

SEQ ID NO: 56 - protein, 1173 aa, Artificial Sequence
  SYNTHETIC FUSION PROTEN
MGSSHHHHHHELPGEFEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQNIGVNELNGRTGLSKDYPDTPEGNKALAAAIVKAFVTDRGVDGLDIDIEHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKDAIAHMNDNVAWFKQAKYGMMIHWGLYSLLAGEYRGESSSAYAEWIQSKFQIPNAEYGNLATAFNPLYFDAKKIVALAKQCGMQYLVVTTKHHDGFAMYHSKVDAYNVYDATPFHRDIIGELAEACQKAGLKFGLYYSQDLDWHDPNGGGYKSNDVETAGTTWDNSWDFPDEDQKNFDLCFDNKILPQIKEIMSNYGDIATAWFDVPMTLSEAQSQTIYDTVRELQPNCLINSRLGNGKYDFVSLGDNEIPKNKEDMNKTDVDYNEITGFKPSPLGLYETAGTINDSWGFSYHDQNWKTPRTLYRYKQHLNDFGINYLLNVGLDPLGRVPMMAEENLLAAKALEDEANREF

SEQ ID NO: 57 - DNA, 3522 bp, Artificial Sequence
  SYNTHETIC FUSION PROTEN
atgggcagcagccatcatcaccatcaccatgagctccccggggaattcgaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcagaagattggtgttaacgaattaaatggacgtacaggtttatctaaagattatcctgatactcctgaggggaacaaagctttagcagcagccattgtcaaggcatttgtaactgatcgtggtgtcgatggactagatattgatattgagcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggatgcgatcgctcatatgaacgacaacgtggcgtggttcaagcaggcgaaatatggcatgatgattcactggggtctgtacagcctgctggcgggcgagtatcgtggtgaaagcagcagcgcgtacgcggagtggatccagagcaagtttcaaattccgaacgcggaatacggcaacctggcgaccgcgttcaacccgctgtattttgatgcgaagaaaatcgttgcgctggcgaaacagtgcggcatgcaatacctggtggttaccaccaagcaccacgacggtttcgcgatgtatcacagcaaagtggacgcgtacaacgtttatgatgcgaccccgtttcaccgtgatatcattggcgagctggcggaagcgtgccagaaggcgggtctgaaattcggtctgtactatagccaagacctggattggcacgacccgaacggtggcggttataagagcaacgatgtggagaccgcgggtaccacctgggacaacagctgggatttcccggacgaagatcagaaaaacttcgacctgtgctttgataacaagatcctgccgcaaatcaaagagattatgagcaactacggtgacattgcgaccgcgtggtttgatgtgccgatgaccctgagcgaggcgcagagccaaaccatctatgacaccgttcgtgaactgcaaccgaactgcctgattaacagccgtctgggcaacggcaagtacgacttcgtgagcctgggcgataacgagatcccgaagaacaaagaagatatgaacaagaccgacgttgattacaacgagattaccggcttcaaaccgagcccgctgggcctgtatgaaaccgcgggtaccatcaacgacagctggggttttagctaccacgatcagaactggaagaccccgcgtaccctgtaccgttataaacaacacctgaacgactttggtattaactacctgctgaacgtgggcctggatccgctgggtcgtgttccgatgatggcggaggaaaacctgctggcggcgaaagcgctggaggacgaagcgaaccgtgaattctaa

SEQ ID NO: 58 - protein, 1173 aa, Artificial Sequence
  SYNTHETIC FUSION PROTEN
MGSSHHHHHHELPGEFEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQKIGVNELNGRTGLSKDYPDTPEGNKALAAAIVKAFVTDRGVDGLDIDIEHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKDAIAHMNDNVAWFKQAKYGMMIHWGLYSLLAGEYRGESSSAYAEWIQSKFQIPNAEYGNLATAFNPLYFDAKKIVALAKQCGMQYLVVTTKHHDGFAMYHSKVDAYNVYDATPFHRDIIGELAEACQKAGLKFGLYYSQDLDWHDPNGGGYKSNDVETAGTTWDNSWDFPDEDQKNFDLCFDNKILPQIKEIMSNYGDIATAWFDVPMTLSEAQSQTIYDTVRELQPNCLINSRLGNGKYDFVSLGDNEIPKNKEDMNKTDVDYNEITGFKPSPLGLYETAGTINDSWGFSYHDQNWKTPRTLYRYKQHLNDFGINYLLNVGLDPLGRVPMMAEENLLAAKALEDEANREF

SEQ ID NO: 59 - DNA, 3522 bp, Artificial Sequence
  SYNTHETIC FUSION PROTEN
atgggcagcagccatcatcaccatcaccatgagctccccggggaattcgaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcagacaattggtgttaacgaattaaatggacgtacaggtttatctaaagattatcctgatactcctgaggggaacaaagctttagcagcagccattgtcaaggcatttgtaactgatcgtggtgtcgatggactacagattgatattgagcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggatgcgatcgctcatatgaacgacaacgtggcgtggttcaagcaggcgaaatatggcatgatgattcactggggtctgtacagcctgctggcgggcgagtatcgtggtgaaagcagcagcgcgtacgcggagtggatccagagcaagtttcaaattccgaacgcggaatacggcaacctggcgaccgcgttcaacccgctgtattttgatgcgaagaaaatcgttgcgctggcgaaacagtgcggcatgcaatacctggtggttaccaccaagcaccacgacggtttcgcgatgtatcacagcaaagtggacgcgtacaacgtttatgatgcgaccccgtttcaccgtgatatcattggcgagctggcggaagcgtgccagaaggcgggtctgaaattcggtctgtactatagccaagacctggattggcacgacccgaacggtggcggttataagagcaacgatgtggagaccgcgggtaccacctgggacaacagctgggatttcccggacgaagatcagaaaaacttcgacctgtgctttgataacaagatcctgccgcaaatcaaagagattatgagcaactacggtgacattgcgaccgcgtggtttgatgtgccgatgaccctgagcgaggcgcagagccaaaccatctatgacaccgttcgtgaactgcaaccgaactgcctgattaacagccgtctgggcaacggcaagtacgacttcgtgagcctgggcgataacgagatcccgaagaacaaagaagatatgaacaagaccgacgttgattacaacgagattaccggcttcaaaccgagcccgctgggcctgtatgaaaccgcgggtaccatcaacgacagctggggttttagctaccacgatcagaactggaagaccccgcgtaccctgtaccgttataaacaacacctgaacgactttggtattaactacctgctgaacgtgggcctggatccgctgggtcgtgttccgatgatggcggaggaaaacctgctggcggcgaaagcgctggaggacgaagcgaaccgtgaattctaa

SEQ ID NO: 60 - protein, 1173 aa, Artificial Sequence
  SYNTHETIC FUSION PROTEN
MGSSHHHHHHELPGEFEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQTIGVNELNGRTGLSKDYPDTPEGNKALAAAIVKAFVTDRGVDGLQIDIEHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKDAIAHMNDNVAWFKQAKYGMMIHWGLYSLLAGEYRGESSSAYAEWIQSKFQIPNAEYGNLATAFNPLYFDAKKIVALAKQCGMQYLVVTTKHHDGFAMYHSKVDAYNVYDATPFHRDIIGELAEACQKAGLKFGLYYSQDLDWHDPNGGGYKSNDVETAGTTWDNSWDFPDEDQKNFDLCFDNKILPQIKEIMSNYGDIATAWFDVPMTLSEAQSQTIYDTVRELQPNCLINSRLGNGKYDFVSLGDNEIPKNKEDMNKTDVDYNEITGFKPSPLGLYETAGTINDSWGFSYHDQNWKTPRTLYRYKQHLNDFGINYLLNVGLDPLGRVPMMAEENLLAAKALEDEANREF

SEQ ID NO: 61 - DNA, 3522 bp, Artificial Sequence
  SYNTHETIC FUSION PROTEN
atgggcagcagccatcatcaccatcaccatgagctccccggggaattcgaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcagacaattggtgttaacgaattaaatggacgtacaggtttatctaaagattatcctgatactcctgaggggaacaaagctttagcagcagccattgtcaaggcatttgtaactgatcgtggtgtcgatggactagatattatgattgagcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggatgcgatcgctcatatgaacgacaacgtggcgtggttcaagcaggcgaaatatggcatgatgattcactggggtctgtacagcctgctggcgggcgagtatcgtggtgaaagcagcagcgcgtacgcggagtggatccagagcaagtttcaaattccgaacgcggaatacggcaacctggcgaccgcgttcaacccgctgtattttgatgcgaagaaaatcgttgcgctggcgaaacagtgcggcatgcaatacctggtggttaccaccaagcaccacgacggtttcgcgatgtatcacagcaaagtggacgcgtacaacgtttatgatgcgaccccgtttcaccgtgatatcattggcgagctggcggaagcgtgccagaaggcgggtctgaaattcggtctgtactatagccaagacctggattggcacgacccgaacggtggcggttataagagcaacgatgtggagaccgcgggtaccacctgggacaacagctgggatttcccggacgaagatcagaaaaacttcgacctgtgctttgataacaagatcctgccgcaaatcaaagagattatgagcaactacggtgacattgcgaccgcgtggtttgatgtgccgatgaccctgagcgaggcgcagagccaaaccatctatgacaccgttcgtgaactgcaaccgaactgcctgattaacagccgtctgggcaacggcaagtacgacttcgtgagcctgggcgataacgagatcccgaagaacaaagaagatatgaacaagaccgacgttgattacaacgagattaccggcttcaaaccgagcccgctgggcctgtatgaaaccgcgggtaccatcaacgacagctggggttttagctaccacgatcagaactggaagaccccgcgtaccctgtaccgttataaacaacacctgaacgactttggtattaactacctgctgaacgtgggcctggatccgctgggtcgtgttccgatgatggcggaggaaaacctgctggcggcgaaagcgctggaggacgaagcgaaccgtgaattctaa

SEQ ID NO: 62 - protein, 1173 aa, Artificial Sequence
  SYNTHETIC FUSION PROTEN
MGSSHHHHHHELPGEFEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQTIGVNELNGRTGLSKDYPDTPEGNKALAAAIVKAFVTDRGVDGLDIMIEHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKDAIAHMNDNVAWFKQAKYGMMIHWGLYSLLAGEYRGESSSAYAEWIQSKFQIPNAEYGNLATAFNPLYFDAKKIVALAKQCGMQYLVVTTKHHDGFAMYHSKVDAYNVYDATPFHRDIIGELAEACQKAGLKFGLYYSQDLDWHDPNGGGYKSNDVETAGTTWDNSWDFPDEDQKNFDLCFDNKILPQIKEIMSNYGDIATAWFDVPMTLSEAQSQTIYDTVRELQPNCLINSRLGNGKYDFVSLGDNEIPKNKEDMNKTDVDYNEITGFKPSPLGLYETAGTINDSWGFSYHDQNWKTPRTLYRYKQHLNDFGINYLLNVGLDPLGRVPMMAEENLLAAKALEDEANREF

SEQ ID NO: 63 - DNA, 3522 bp, Artificial Sequence
  SYNTHETIC FUSION PROTEN
atgggcagcagccatcatcaccatcaccatgagctccccggggaattcgaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcagacaattggtgttaacgaattaaatggacgtacaggtttatctaaagattatcctgatactcctgaggggaacaaagctttagcagcagccattgtcaaggcatttgtaactgatcgtggtgtcgatggactagatattcagattgagcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggatgcgatcgctcatatgaacgacaacgtggcgtggttcaagcaggcgaaatatggcatgatgattcactggggtctgtacagcctgctggcgggcgagtatcgtggtgaaagcagcagcgcgtacgcggagtggatccagagcaagtttcaaattccgaacgcggaatacggcaacctggcgaccgcgttcaacccgctgtattttgatgcgaagaaaatcgttgcgctggcgaaacagtgcggcatgcaatacctggtggttaccaccaagcaccacgacggtttcgcgatgtatcacagcaaagtggacgcgtacaacgtttatgatgcgaccccgtttcaccgtgatatcattggcgagctggcggaagcgtgccagaaggcgggtctgaaattcggtctgtactatagccaagacctggattggcacgacccgaacggtggcggttataagagcaacgatgtggagaccgcgggtaccacctgggacaacagctgggatttcccggacgaagatcagaaaaacttcgacctgtgctttgataacaagatcctgccgcaaatcaaagagattatgagcaactacggtgacattgcgaccgcgtggtttgatgtgccgatgaccctgagcgaggcgcagagccaaaccatctatgacaccgttcgtgaactgcaaccgaactgcctgattaacagccgtctgggcaacggcaagtacgacttcgtgagcctgggcgataacgagatcccgaagaacaaagaagatatgaacaagaccgacgttgattacaacgagattaccggcttcaaaccgagcccgctgggcctgtatgaaaccgcgggtaccatcaacgacagctggggttttagctaccacgatcagaactggaagaccccgcgtaccctgtaccgttataaacaacacctgaacgactttggtattaactacctgctgaacgtgggcctggatccgctgggtcgtgttccgatgatggcggaggaaaacctgctggcggcgaaagcgctggaggacgaagcgaaccgtgaattctaa

SEQ ID NO: 64 - protein, 1173 aa, Artificial Sequence
  SYNTHETIC FUSION PROTEN
MGSSHHHHHHELPGEFEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQTIGVNELNGRTGLSKDYPDTPEGNKALAAAIVKAFVTDRGVDGLDIQIEHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKDAIAHMNDNVAWFKQAKYGMMIHWGLYSLLAGEYRGESSSAYAEWIQSKFQIPNAEYGNLATAFNPLYFDAKKIVALAKQCGMQYLVVTTKHHDGFAMYHSKVDAYNVYDATPFHRDIIGELAEACQKAGLKFGLYYSQDLDWHDPNGGGYKSNDVETAGTTWDNSWDFPDEDQKNFDLCFDNKILPQIKEIMSNYGDIATAWFDVPMTLSEAQSQTIYDTVRELQPNCLINSRLGNGKYDFVSLGDNEIPKNKEDMNKTDVDYNEITGFKPSPLGLYETAGTINDSWGFSYHDQNWKTPRTLYRYKQHLNDFGINYLLNVGLDPLGRVPMMAEENLLAAKALEDEANREF

SEQ ID NO: 65 - DNA, 3522 bp, Artificial Sequence
  SYNTHETIC FUSION PROTEN
atgggcagcagccatcatcaccatcaccatgagctccccggggaattcgaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcagacaattggtgttaacgaattaaatggacgtacaggtttatctaaagattatcctgatactcctgaggggaacaaagctttagcagcagccattgtcaaggcatttgtaactgatcgtggtgtcgatggactagatattaccattgagcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggatgcgatcgctcatatgaacgacaacgtggcgtggttcaagcaggcgaaatatggcatgatgattcactggggtctgtacagcctgctggcgggcgagtatcgtggtgaaagcagcagcgcgtacgcggagtggatccagagcaagtttcaaattccgaacgcggaatacggcaacctggcgaccgcgttcaacccgctgtattttgatgcgaagaaaatcgttgcgctggcgaaacagtgcggcatgcaatacctggtggttaccaccaagcaccacgacggtttcgcgatgtatcacagcaaagtggacgcgtacaacgtttatgatgcgaccccgtttcaccgtgatatcattggcgagctggcggaagcgtgccagaaggcgggtctgaaattcggtctgtactatagccaagacctggattggcacgacccgaacggtggcggttataagagcaacgatgtggagaccgcgggtaccacctgggacaacagctgggatttcccggacgaagatcagaaaaacttcgacctgtgctttgataacaagatcctgccgcaaatcaaagagattatgagcaactacggtgacattgcgaccgcgtggtttgatgtgccgatgaccctgagcgaggcgcagagccaaaccatctatgacaccgttcgtgaactgcaaccgaactgcctgattaacagccgtctgggcaacggcaagtacgacttcgtgagcctgggcgataacgagatcccgaagaacaaagaagatatgaacaagaccgacgttgattacaacgagattaccggcttcaaaccgagcccgctgggcctgtatgaaaccgcgggtaccatcaacgacagctggggttttagctaccacgatcagaactggaagaccccgcgtaccctgtaccgttataaacaacacctgaacgactttggtattaactacctgctgaacgtgggcctggatccgctgggtcgtgttccgatgatggcggaggaaaacctgctggcggcgaaagcgctggaggacgaagcgaaccgtgaattctaa

SEQ ID NO: 66 - protein, 1173 aa, Artificial Sequence
  SYNTHETIC FUSION PROTEN
MGSSHHHHHHELPGEFEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQTIGVNELNGRTGLSKDYPDTPEGNKALAAAIVKAFVTDRGVDGLDITIEHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKDAIAHMNDNVAWFKQAKYGMMIHWGLYSLLAGEYRGESSSAYAEWIQSKFQIPNAEYGNLATAFNPLYFDAKKIVALAKQCGMQYLVVTTKHHDGFAMYHSKVDAYNVYDATPFHRDIIGELAEACQKAGLKFGLYYSQDLDWHDPNGGGYKSNDVETAGTTWDNSWDFPDEDQKNFDLCFDNKILPQIKEIMSNYGDIATAWFDVPMTLSEAQSQTIYDTVRELQPNCLINSRLGNGKYDFVSLGDNEIPKNKEDMNKTDVDYNEITGFKPSPLGLYETAGTINDSWGFSYHDQNWKTPRTLYRYKQHLNDFGINYLLNVGLDPLGRVPMMAEENLLAAKALEDEANREF

SEQ ID NO: 67 - DNA, 3522 bp, Artificial Sequence
  SYNTHETIC FUSION PROTEN
atgggcagcagccatcatcaccatcaccatgagctccccggggaattcgaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcagacaattggtgttaacgaattaaatggacgtacaggtttatctaaagattatcctgatactcctgaggggaacaaagctttagcagcagccattgtcaaggcatttgtaactgatcgtggtgtcgatggactagatattttgattgagcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggatgcgatcgctcatatgaacgacaacgtggcgtggttcaagcaggcgaaatatggcatgatgattcactggggtctgtacagcctgctggcgggcgagtatcgtggtgaaagcagcagcgcgtacgcggagtggatccagagcaagtttcaaattccgaacgcggaatacggcaacctggcgaccgcgttcaacccgctgtattttgatgcgaagaaaatcgttgcgctggcgaaacagtgcggcatgcaatacctggtggttaccaccaagcaccacgacggtttcgcgatgtatcacagcaaagtggacgcgtacaacgtttatgatgcgaccccgtttcaccgtgatatcattggcgagctggcggaagcgtgccagaaggcgggtctgaaattcggtctgtactatagccaagacctggattggcacgacccgaacggtggcggttataagagcaacgatgtggagaccgcgggtaccacctgggacaacagctgggatttcccggacgaagatcagaaaaacttcgacctgtgctttgataacaagatcctgccgcaaatcaaagagattatgagcaactacggtgacattgcgaccgcgtggtttgatgtgccgatgaccctgagcgaggcgcagagccaaaccatctatgacaccgttcgtgaactgcaaccgaactgcctgattaacagccgtctgggcaacggcaagtacgacttcgtgagcctgggcgataacgagatcccgaagaacaaagaagatatgaacaagaccgacgttgattacaacgagattaccggcttcaaaccgagcccgctgggcctgtatgaaaccgcgggtaccatcaacgacagctggggttttagctaccacgatcagaactggaagaccccgcgtaccctgtaccgttataaacaacacctgaacgactttggtattaactacctgctgaacgtgggcctggatccgctgggtcgtgttccgatgatggcggaggaaaacctgctggcggcgaaagcgctggaggacgaagcgaaccgtgaattctaa

SEQ ID NO: 68 - protein, 1173 aa, Artificial Sequence
  SYNTHETIC FUSION PROTEN
MGSSHHHHHHELPGEFEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQTIGVNELNGRTGLSKDYPDTPEGNKALAAAIVKAFVTDRGVDGLDILIEHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKDAIAHMNDNVAWFKQAKYGMMIHWGLYSLLAGEYRGESSSAYAEWIQSKFQIPNAEYGNLATAFNPLYFDAKKIVALAKQCGMQYLVVTTKHHDGFAMYHSKVDAYNVYDATPFHRDIIGELAEACQKAGLKFGLYYSQDLDWHDPNGGGYKSNDVETAGTTWDNSWDFPDEDQKNFDLCFDNKILPQIKEIMSNYGDIATAWFDVPMTLSEAQSQTIYDTVRELQPNCLINSRLGNGKYDFVSLGDNEIPKNKEDMNKTDVDYNEITGFKPSPLGLYETAGTINDSWGFSYHDQNWKTPRTLYRYKQHLNDFGINYLLNVGLDPLGRVPMMAEENLLAAKALEDEANREF

SEQ ID NO: 69 - DNA, 3522 bp, Artificial Sequence
  SYNTHETIC FUSION PROTEN
atgggcagcagccatcatcaccatcaccatgagctccccggggaattcgaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcagacaattggtgttaacgaattaaatggacgtacaggtttatctaaagattatcctgatactcctgaggggaacaaagctttagcagcagccattgtcaaggcatttgtaactgatcgtggtgtcgatggactagatatttttattgagcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggatgcgatcgctcatatgaacgacaacgtggcgtggttcaagcaggcgaaatatggcatgatgattcactggggtctgtacagcctgctggcgggcgagtatcgtggtgaaagcagcagcgcgtacgcggagtggatccagagcaagtttcaaattccgaacgcggaatacggcaacctggcgaccgcgttcaacccgctgtattttgatgcgaagaaaatcgttgcgctggcgaaacagtgcggcatgcaatacctggtggttaccaccaagcaccacgacggtttcgcgatgtatcacagcaaagtggacgcgtacaacgtttatgatgcgaccccgtttcaccgtgatatcattggcgagctggcggaagcgtgccagaaggcgggtctgaaattcggtctgtactatagccaagacctggattggcacgacccgaacggtggcggttataagagcaacgatgtggagaccgcgggtaccacctgggacaacagctgggatttcccggacgaagatcagaaaaacttcgacctgtgctttgataacaagatcctgccgcaaatcaaagagattatgagcaactacggtgacattgcgaccgcgtggtttgatgtgccgatgaccctgagcgaggcgcagagccaaaccatctatgacaccgttcgtgaactgcaaccgaactgcctgattaacagccgtctgggcaacggcaagtacgacttcgtgagcctgggcgataacgagatcccgaagaacaaagaagatatgaacaagaccgacgttgattacaacgagattaccggcttcaaaccgagcccgctgggcctgtatgaaaccgcgggtaccatcaacgacagctggggttttagctaccacgatcagaactggaagaccccgcgtaccctgtaccgttataaacaacacctgaacgactttggtattaactacctgctgaacgtgggcctggatccgctgggtcgtgttccgatgatggcggaggaaaacctgctggcggcgaaagcgctggaggacgaagcgaaccgtgaattctaa

SEQ ID NO: 70 - protein, 1173 aa, Artificial Sequence
  SYNTHETIC FUSION PROTEN
MGSSHHHHHHELPGEFEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQTIGVNELNGRTGLSKDYPDTPEGNKALAAAIVKAFVTDRGVDGLDIFIEHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKDAIAHMNDNVAWFKQAKYGMMIHWGLYSLLAGEYRGESSSAYAEWIQSKFQIPNAEYGNLATAFNPLYFDAKKIVALAKQCGMQYLVVTTKHHDGFAMYHSKVDAYNVYDATPFHRDIIGELAEACQKAGLKFGLYYSQDLDWHDPNGGGYKSNDVETAGTTWDNSWDFPDEDQKNFDLCFDNKILPQIKEIMSNYGDIATAWFDVPMTLSEAQSQTIYDTVRELQPNCLINSRLGNGKYDFVSLGDNEIPKNKEDMNKTDVDYNEITGFKPSPLGLYETAGTINDSWGFSYHDQNWKTPRTLYRYKQHLNDFGINYLLNVGLDPLGRVPMMAEENLLAAKALEDEANREF

SEQ ID NO: 71 - DNA, 3522 bp, Artificial Sequence
  SYNTHETIC FUSION PROTEN
atgggcagcagccatcatcaccatcaccatgagctccccggggaattcgaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcagacaattggtgttaacgaattaaatggacgtacaggtttatctaaagattatcctgatactcctgaggggaacaaagctttagcagcagccattgtcaaggcatttgtaactgatcgtggtgtcgatggactagatatttctattgagcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggatgcgatcgctcatatgaacgacaacgtggcgtggttcaagcaggcgaaatatggcatgatgattcactggggtctgtacagcctgctggcgggcgagtatcgtggtgaaagcagcagcgcgtacgcggagtggatccagagcaagtttcaaattccgaacgcggaatacggcaacctggcgaccgcgttcaacccgctgtattttgatgcgaagaaaatcgttgcgctggcgaaacagtgcggcatgcaatacctggtggttaccaccaagcaccacgacggtttcgcgatgtatcacagcaaagtggacgcgtacaacgtttatgatgcgaccccgtttcaccgtgatatcattggcgagctggcggaagcgtgccagaaggcgggtctgaaattcggtctgtactatagccaagacctggattggcacgacccgaacggtggcggttataagagcaacgatgtggagaccgcgggtaccacctgggacaacagctgggatttcccggacgaagatcagaaaaacttcgacctgtgctttgataacaagatcctgccgcaaatcaaagagattatgagcaactacggtgacattgcgaccgcgtggtttgatgtgccgatgaccctgagcgaggcgcagagccaaaccatctatgacaccgttcgtgaactgcaaccgaactgcctgattaacagccgtctgggcaacggcaagtacgacttcgtgagcctgggcgataacgagatcccgaagaacaaagaagatatgaacaagaccgacgttgattacaacgagattaccggcttcaaaccgagcccgctgggcctgtatgaaaccgcgggtaccatcaacgacagctggggttttagctaccacgatcagaactggaagaccccgcgtaccctgtaccgttataaacaacacctgaacgactttggtattaactacctgctgaacgtgggcctggatccgctgggtcgtgttccgatgatggcggaggaaaacctgctggcggcgaaagcgctggaggacgaagcgaaccgtgaattctaa

SEQ ID NO: 72 - protein, 1173 aa, Artificial Sequence
  SYNTHETIC FUSION PROTEN
MGSSHHHHHHELPGEFEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQTIGVNELNGRTGLSKDYPDTPEGNKALAAAIVKAFVTDRGVDGLDISIEHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKDAIAHMNDNVAWFKQAKYGMMIHWGLYSLLAGEYRGESSSAYAEWIQSKFQIPNAEYGNLATAFNPLYFDAKKIVALAKQCGMQYLVVTTKHHDGFAMYHSKVDAYNVYDATPFHRDIIGELAEACQKAGLKFGLYYSQDLDWHDPNGGGYKSNDVETAGTTWDNSWDFPDEDQKNFDLCFDNKILPQIKEIMSNYGDIATAWFDVPMTLSEAQSQTIYDTVRELQPNCLINSRLGNGKYDFVSLGDNEIPKNKEDMNKTDVDYNEITGFKPSPLGLYETAGTINDSWGFSYHDQNWKTPRTLYRYKQHLNDFGINYLLNVGLDPLGRVPMMAEENLLAAKALEDEANREF

SEQ ID NO: 73 - DNA, 3522 bp, Artificial Sequence
  SYNTHETIC FUSION PROTEN
atgggcagcagccatcatcaccatcaccatgagctccccggggaattcgaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcagacaattggtgttaacgaattaaatggacgtacaggtttatctaaagattatcctgatactcctgaggggaacaaagctttagcagcagccattgtcaaggcatttgtaactgatcgtggtgtcgatggactagatattgtgattgagcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggatgcgatcgctcatatgaacgacaacgtggcgtggttcaagcaggcgaaatatggcatgatgattcactggggtctgtacagcctgctggcgggcgagtatcgtggtgaaagcagcagcgcgtacgcggagtggatccagagcaagtttcaaattccgaacgcggaatacggcaacctggcgaccgcgttcaacccgctgtattttgatgcgaagaaaatcgttgcgctggcgaaacagtgcggcatgcaatacctggtggttaccaccaagcaccacgacggtttcgcgatgtatcacagcaaagtggacgcgtacaacgtttatgatgcgaccccgtttcaccgtgatatcattggcgagctggcggaagcgtgccagaaggcgggtctgaaattcggtctgtactatagccaagacctggattggcacgacccgaacggtggcggttataagagcaacgatgtggagaccgcgggtaccacctgggacaacagctgggatttcccggacgaagatcagaaaaacttcgacctgtgctttgataacaagatcctgccgcaaatcaaagagattatgagcaactacggtgacattgcgaccgcgtggtttgatgtgccgatgaccctgagcgaggcgcagagccaaaccatctatgacaccgttcgtgaactgcaaccgaactgcctgattaacagccgtctgggcaacggcaagtacgacttcgtgagcctgggcgataacgagatcccgaagaacaaagaagatatgaacaagaccgacgttgattacaacgagattaccggcttcaaaccgagcccgctgggcctgtatgaaaccgcgggtaccatcaacgacagctggggttttagctaccacgatcagaactggaagaccccgcgtaccctgtaccgttataaacaacacctgaacgactttggtattaactacctgctgaacgtgggcctggatccgctgggtcgtgttccgatgatggcggaggaaaacctgctggcggcgaaagcgctggaggacgaagcgaaccgtgaattctaa

SEQ ID NO: 74 - protein, 1173 aa, Artificial Sequence
  SYNTHETIC FUSION PROTEN
MGSSHHHHHHELPGEFEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQTIGVNELNGRTGLSKDYPDTPEGNKALAAAIVKAFVTDRGVDGLDIVIEHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKDAIAHMNDNVAWFKQAKYGMMIHWGLYSLLAGEYRGESSSAYAEWIQSKFQIPNAEYGNLATAFNPLYFDAKKIVALAKQCGMQYLVVTTKHHDGFAMYHSKVDAYNVYDATPFHRDIIGELAEACQKAGLKFGLYYSQDLDWHDPNGGGYKSNDVETAGTTWDNSWDFPDEDQKNFDLCFDNKILPQIKEIMSNYGDIATAWFDVPMTLSEAQSQTIYDTVRELQPNCLINSRLGNGKYDFVSLGDNEIPKNKEDMNKTDVDYNEITGFKPSPLGLYETAGTINDSWGFSYHDQNWKTPRTLYRYKQHLNDFGINYLLNVGLDPLGRVPMMAEENLLAAKALEDEANREF

SEQ ID NO: 75 - DNA, 3522 bp, Artificial Sequence
  SYNTHETIC FUSION PROTEN
atgggcagcagccatcatcaccatcaccatgagctccccggggaattcgaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcagacaattggtgttaacgaattaaatggacgtacaggtttatctaaagattatcctgatactcctgaggggaacaaagctttagcagcagccattgtcaaggcatttgtaactgatcgtggtgtcgatggactagatattaagattgagcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggatgcgatcgctcatatgaacgacaacgtggcgtggttcaagcaggcgaaatatggcatgatgattcactggggtctgtacagcctgctggcgggcgagtatcgtggtgaaagcagcagcgcgtacgcggagtggatccagagcaagtttcaaattccgaacgcggaatacggcaacctggcgaccgcgttcaacccgctgtattttgatgcgaagaaaatcgttgcgctggcgaaacagtgcggcatgcaatacctggtggttaccaccaagcaccacgacggtttcgcgatgtatcacagcaaagtggacgcgtacaacgtttatgatgcgaccccgtttcaccgtgatatcattggcgagctggcggaagcgtgccagaaggcgggtctgaaattcggtctgtactatagccaagacctggattggcacgacccgaacggtggcggttataagagcaacgatgtggagaccgcgggtaccacctgggacaacagctgggatttcccggacgaagatcagaaaaacttcgacctgtgctttgataacaagatcctgccgcaaatcaaagagattatgagcaactacggtgacattgcgaccgcgtggtttgatgtgccgatgaccctgagcgaggcgcagagccaaaccatctatgacaccgttcgtgaactgcaaccgaactgcctgattaacagccgtctgggcaacggcaagtacgacttcgtgagcctgggcgataacgagatcccgaagaacaaagaagatatgaacaagaccgacgttgattacaacgagattaccggcttcaaaccgagcccgctgggcctgtatgaaaccgcgggtaccatcaacgacagctggggttttagctaccacgatcagaactggaagaccccgcgtaccctgtaccgttataaacaacacctgaacgactttggtattaactacctgctgaacgtgggcctggatccgctgggtcgtgttccgatgatggcggaggaaaacctgctggcggcgaaagcgctggaggacgaagcgaaccgtgaattctaa

SEQ ID NO: 76 - protein, 1173 aa, Artificial Sequence
  SYNTHETIC FUSION PROTEN
MGSSHHHHHHELPGEFEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQTIGVNELNGRTGLSKDYPDTPEGNKALAAAIVKAFVTDRGVDGLDIKIEHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKDAIAHMNDNVAWFKQAKYGMMIHWGLYSLLAGEYRGESSSAYAEWIQSKFQIPNAEYGNLATAFNPLYFDAKKIVALAKQCGMQYLVVTTKHHDGFAMYHSKVDAYNVYDATPFHRDIIGELAEACQKAGLKFGLYYSQDLDWHDPNGGGYKSNDVETAGTTWDNSWDFPDEDQKNFDLCFDNKILPQIKEIMSNYGDIATAWFDVPMTLSEAQSQTIYDTVRELQPNCLINSRLGNGKYDFVSLGDNEIPKNKEDMNKTDVDYNEITGFKPSPLGLYETAGTINDSWGFSYHDQNWKTPRTLYRYKQHLNDFGINYLLNVGLDPLGRVPMMAEENLLAAKALEDEANREF

SEQ ID NO: 77 - DNA, 3522 bp, Artificial Sequence
  SYNTHETIC FUSION PROTEN
atgggcagcagccatcatcaccatcaccatgagctccccggggaattcgaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcagacaattggtgttaacgaattaaatggacgtacaggtttatctaaagattatcctgatactcctgaggggaacaaagctttagcagcagccattgtcaaggcatttgtaactgatcgtggtgtcgatggactagatatttggattgagcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggatgcgatcgctcatatgaacgacaacgtggcgtggttcaagcaggcgaaatatggcatgatgattcactggggtctgtacagcctgctggcgggcgagtatcgtggtgaaagcagcagcgcgtacgcggagtggatccagagcaagtttcaaattccgaacgcggaatacggcaacctggcgaccgcgttcaacccgctgtattttgatgcgaagaaaatcgttgcgctggcgaaacagtgcggcatgcaatacctggtggttaccaccaagcaccacgacggtttcgcgatgtatcacagcaaagtggacgcgtacaacgtttatgatgcgaccccgtttcaccgtgatatcattggcgagctggcggaagcgtgccagaaggcgggtctgaaattcggtctgtactatagccaagacctggattggcacgacccgaacggtggcggttataagagcaacgatgtggagaccgcgggtaccacctgggacaacagctgggatttcccggacgaagatcagaaaaacttcgacctgtgctttgataacaagatcctgccgcaaatcaaagagattatgagcaactacggtgacattgcgaccgcgtggtttgatgtgccgatgaccctgagcgaggcgcagagccaaaccatctatgacaccgttcgtgaactgcaaccgaactgcctgattaacagccgtctgggcaacggcaagtacgacttcgtgagcctgggcgataacgagatcccgaagaacaaagaagatatgaacaagaccgacgttgattacaacgagattaccggcttcaaaccgagcccgctgggcctgtatgaaaccgcgggtaccatcaacgacagctggggttttagctaccacgatcagaactggaagaccccgcgtaccctgtaccgttataaacaacacctgaacgactttggtattaactacctgctgaacgtgggcctggatccgctgggtcgtgttccgatgatggcggaggaaaacctgctggcggcgaaagcgctggaggacgaagcgaaccgtgaattctaa

SEQ ID NO: 78 - protein, 1173 aa, Artificial Sequence
  SYNTHETIC FUSION PROTEN
MGSSHHHHHHELPGEFEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQTIGVNELNGRTGLSKDYPDTPEGNKALAAAIVKAFVTDRGVDGLDIWIEHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKDAIAHMNDNVAWFKQAKYGMMIHWGLYSLLAGEYRGESSSAYAEWIQSKFQIPNAEYGNLATAFNPLYFDAKKIVALAKQCGMQYLVVTTKHHDGFAMYHSKVDAYNVYDATPFHRDIIGELAEACQKAGLKFGLYYSQDLDWHDPNGGGYKSNDVETAGTTWDNSWDFPDEDQKNFDLCFDNKILPQIKEIMSNYGDIATAWFDVPMTLSEAQSQTIYDTVRELQPNCLINSRLGNGKYDFVSLGDNEIPKNKEDMNKTDVDYNEITGFKPSPLGLYETAGTINDSWGFSYHDQNWKTPRTLYRYKQHLNDFGINYLLNVGLDPLGRVPMMAEENLLAAKALEDEANREF

SEQ ID NO: 79 - DNA, 3537 bp, Artificial Sequence
  SYNTHETIC FUSION PROTEN
atgggcagcagccatcatcaccatcaccatgagctccccggggaattcgaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcagacaattggtgttaacgaattaaatggacgtacaggtttatctaaagattatcctgatactcctgaggggaacaaagctttagcagcagccattgtcaaggcatttgtaactgatcgtggtgtcgatggactagatattatgattgagcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggatggcggtggcggatcgggcggaggtggctctaacgacaacgtggcgtggttcaagcaggcgaaatatggcatgatgattcactggggtctgtacagcctgctggcgggcgagtatcgtggtgaaagcagcagcgcgtacgcggagtggatccagagcaagtttcaaattccgaacgcggaatacggcaacctggcgaccgcgttcaacccgctgtattttgatgcgaagaaaatcgttgcgctggcgaaacagtgcggcatgcaatacctggtggttaccaccaagcaccacgacggtttcgcgatgtatcacagcaaagtggacgcgtacaacgtttatgatgcgaccccgtttcaccgtgatatcattggcgagctggcggaagcgtgccagaaggcgggtctgaaattcggtctgtactatagccaagacctggattggcacgacccgaacggtggcggttataagagcaacgatgtggagaccgcgggtaccacctgggacaacagctgggatttcccggacgaagatcagaaaaacttcgacctgtgctttgataacaagatcctgccgcaaatcaaagagattatgagcaactacggtgacattgcgaccgcgtggtttgatgtgccgatgaccctgagcgaggcgcagagccaaaccatctatgacaccgttcgtgaactgcaaccgaactgcctgattaacagccgtctgggcaacggcaagtacgacttcgtgagcctgggcgataacgagatcccgaagaacaaagaagatatgaacaagaccgacgttgattacaacgagattaccggcttcaaaccgagcccgctgggcctgtatgaaaccgcgggtaccatcaacgacagctggggttttagctaccacgatcagaactggaagaccccgcgtaccctgtaccgttataaacaacacctgaacgactttggtattaactacctgctgaacgtgggcctggatccgctgggtcgtgttccgatgatggcggaggaaaacctgctggcggcgaaagcgctggaggacgaagcgaaccgtgaattctaa

SEQ ID NO: 80 - protein, 1178 aa, Artificial Sequence
  SYNTHETIC FUSION PROTEN
MGSSHHHHHHELPGEFEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQTIGVNELNGRTGLSKDYPDTPEGNKALAAAIVKAFVTDRGVDGLDIMIEHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKDGGGGSGGGGSNDNVAWFKQAKYGMMIHWGLYSLLAGEYRGESSSAYAEWIQSKFQIPNAEYGNLATAFNPLYFDAKKIVALAKQCGMQYLVVTTKHHDGFAMYHSKVDAYNVYDATPFHRDIIGELAEACQKAGLKFGLYYSQDLDWHDPNGGGYKSNDVETAGTTWDNSWDFPDEDQKNFDLCFDNKILPQIKEIMSNYGDIATAWFDVPMTLSEAQSQTIYDTVRELQPNCLINSRLGNGKYDFVSLGDNEIPKNKEDMNKTDVDYNEITGFKPSPLGLYETAGTINDSWGFSYHDQNWKTPRTLYRYKQHLNDFGINYLLNVGLDPLGRVPMMAEENLLAAKALEDEANREF

SEQ ID NO: 81 - DNA, 3567 bp, Artificial Sequence
  SYNTHETIC FUSION PROTEN
atgggcagcagccatcatcaccatcaccatgagctccccggggaattcgaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcagacaattggtgttaacgaattaaatggacgtacaggtttatctaaagattatcctgatactcctgaggggaacaaagctttagcagcagccattgtcaaggcatttgtaactgatcgtggtgtcgatggactagatattatgattgagcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggatggcggtggcggatcgggcggtggcggatcgggtggtggtggttctggtggtggtggttctaacgacaacgtggcgtggttcaagcaggcgaaatatggcatgatgattcactggggtctgtacagcctgctggcgggcgagtatcgtggtgaaagcagcagcgcgtacgcggagtggatccagagcaagtttcaaattccgaacgcggaatacggcaacctggcgaccgcgttcaacccgctgtattttgatgcgaagaaaatcgttgcgctggcgaaacagtgcggcatgcaatacctggtggttaccaccaagcaccacgacggtttcgcgatgtatcacagcaaagtggacgcgtacaacgtttatgatgcgaccccgtttcaccgtgatatcattggcgagctggcggaagcgtgccagaaggcgggtctgaaattcggtctgtactatagccaagacctggattggcacgacccgaacggtggcggttataagagcaacgatgtggagaccgcgggtaccacctgggacaacagctgggatttcccggacgaagatcagaaaaacttcgacctgtgctttgataacaagatcctgccgcaaatcaaagagattatgagcaactacggtgacattgcgaccgcgtggtttgatgtgccgatgaccctgagcgaggcgcagagccaaaccatctatgacaccgttcgtgaactgcaaccgaactgcctgattaacagccgtctgggcaacggcaagtacgacttcgtgagcctgggcgataacgagatcccgaagaacaaagaagatatgaacaagaccgacgttgattacaacgagattaccggcttcaaaccgagcccgctgggcctgtatgaaaccgcgggtaccatcaacgacagctggggttttagctaccacgatcagaactggaagaccccgcgtaccctgtaccgttataaacaacacctgaacgactttggtattaactacctgctgaacgtgggcctggatccgctgggtcgtgttccgatgatggcggaggaaaacctgctggcggcgaaagcgctggaggacgaagcgaaccgtgaattctaa

SEQ ID NO: 82 - protein, 1188 aa, Artificial Sequence
  SYNTHETIC FUSION PROTEN
MGSSHHHHHHELPGEFEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQTIGVNELNGRTGLSKDYPDTPEGNKALAAAIVKAFVTDRGVDGLDIMIEHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKDGGGGSGGGGSGGGGSGGGGSNDNVAWFKQAKYGMMIHWGLYSLLAGEYRGESSSAYAEWIQSKFQIPNAEYGNLATAFNPLYFDAKKIVALAKQCGMQYLVVTTKHHDGFAMYHSKVDAYNVYDATPFHRDIIGELAEACQKAGLKFGLYYSQDLDWHDPNGGGYKSNDVETAGTTWDNSWDFPDEDQKNFDLCFDNKILPQIKEIMSNYGDIATAWFDVPMTLSEAQSQTIYDTVRELQPNCLINSRLGNGKYDFVSLGDNEIPKNKEDMNKTDVDYNEITGFKPSPLGLYETAGTINDSWGFSYHDQNWKTPRTLYRYKQHLNDFGINYLLNVGLDPLGRVPMMAEENLLAAKALEDEANREF

SEQ ID NO: 83 - DNA, 3522 bp, Artificial Sequence
  SYNTHETIC FUSION PROTEN
atgggcagcagccatcatcaccatcaccatgagctccccggggaattcgaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcagacaattggtgttaacgaattaaatggacgtacaggtttatctaaagattatcctgatactcctgaggggaacaaagctttagcagcagccattgtcaaggcatttgtaactgatcgtggtgtcgatggactagatattgatattgcgcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggatgcgatcgctcatatgaacgacaacgtggcgtggttcaagcaggcgaaatatggcatgatgattcactggggtctgtacagcctgctggcgggcgagtatcgtggtgaaagcagcagcgcgtacgcggagtggatccagagcaagtttcaaattccgaacgcggaatacggcaacctggcgaccgcgttcaacccgctgtattttgatgcgaagaaaatcgttgcgctggcgaaacagtgcggcatgcaatacctggtggttaccaccaagcaccacgacggtttcgcgatgtatcacagcaaagtggacgcgtacaacgtttatgatgcgaccccgtttcaccgtgatatcattggcgagctggcggaagcgtgccagaaggcgggtctgaaattcggtctgtactatagccaagacctggattggcacgacccgaacggtggcggttataagagcaacgatgtggagaccgcgggtaccacctgggacaacagctgggatttcccggacgaagatcagaaaaacttcgacctgtgctttgataacaagatcctgccgcaaatcaaagagattatgagcaactacggtgacattgcgaccgcgtggtttgatgtgccgatgaccctgagcgaggcgcagagccaaaccatctatgacaccgttcgtgaactgcaaccgaactgcctgattaacagccgtctgggcaacggcaagtacgacttcgtgagcctgggcgataacgagatcccgaagaacaaagaagatatgaacaagaccgacgttgattacaacgagattaccggcttcaaaccgagcccgctgggcctgtatgaaaccgcgggtaccatcaacgacagctggggttttagctaccacgatcagaactggaagaccccgcgtaccctgtaccgttataaacaacacctgaacgactttggtattaactacctgctgaacgtgggcctggatccgctgggtcgtgttccgatgatggcggaggaaaacctgctggcggcgaaagcgctggaggacgaagcgaaccgtgaattctaa

SEQ ID NO: 84 - protein, 1173 aa, Artificial Sequence
  SYNTHETIC FUSION PROTEN
MGSSHHHHHHELPGEFEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQTIGVNELNGRTGLSKDYPDTPEGNKALAAAIVKAFVTDRGVDGLDIDIAHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKDAIAHMNDNVAWFKQAKYGMMIHWGLYSLLAGEYRGESSSAYAEWIQSKFQIPNAEYGNLATAFNPLYFDAKKIVALAKQCGMQYLVVTTKHHDGFAMYHSKVDAYNVYDATPFHRDIIGELAEACQKAGLKFGLYYSQDLDWHDPNGGGYKSNDVETAGTTWDNSWDFPDEDQKNFDLCFDNKILPQIKEIMSNYGDIATAWFDVPMTLSEAQSQTIYDTVRELQPNCLINSRLGNGKYDFVSLGDNEIPKNKEDMNKTDVDYNEITGFKPSPLGLYETAGTINDSWGFSYHDQNWKTPRTLYRYKQHLNDFGINYLLNVGLDPLGRVPMMAEENLLAAKALEDEANREF

SEQ ID NO: 85 - DNA, 3522 bp, Artificial Sequence
  SYNTHETIC FUSION PROTEN
atgggcagcagccatcatcaccatcaccatgagctccccggggaattcgaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcagacaattggtgttaacgaattaaatggacgtacaggtttatctaaagattatcctgatactcctgaggggaacaaagctttagcagcagccattgtcaaggcatttgtaactgatcgtggtgtcgatggactagatattgatattgagcacgaatttacgaacaaaagaacacctgaagaagatgctcgtgctctaaatgtttttaaagagattgcgcagttaataggtaaaaatggtagtgataaatctaaattgctcatcatgcagactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggatgcgatcgctcatatgaacgacaacgtggcgtggttcaagcaggcgaaatatggcatgatgattcactggggtctgtacagcctgctggcgggcgagtatcgtggtgaaagcagcagcgcgtacgcggagtggatccagagcaagtttcaaattccgaacgcggaatacggcaacctggcgaccgcgttcaacccgctgtattttgatgcgaagaaaatcgttgcgctggcgaaacagtgcggcatgcaatacctggtggttaccaccaagcaccacgacggtttcgcgatgtatcacagcaaagtggacgcgtacaacgtttatgatgcgaccccgtttcaccgtgatatcattggcgagctggcggaagcgtgccagaaggcgggtctgaaattcggtctgtactatagccaagacctggattggcacgacccgaacggtggcggttataagagcaacgatgtggagaccgcgggtaccacctgggacaacagctgggatttcccggacgaagatcagaaaaacttcgacctgtgctttgataacaagatcctgccgcaaatcaaagagattatgagcaactacggtgacattgcgaccgcgtggtttgatgtgccgatgaccctgagcgaggcgcagagccaaaccatctatgacaccgttcgtgaactgcaaccgaactgcctgattaacagccgtctgggcaacggcaagtacgacttcgtgagcctgggcgataacgagatcccgaagaacaaagaagatatgaacaagaccgacgttgattacaacgagattaccggcttcaaaccgagcccgctgggcctgtatgaaaccgcgggtaccatcaacgacagctggggttttagctaccacgatcagaactggaagaccccgcgtaccctgtaccgttataaacaacacctgaacgactttggtattaactacctgctgaacgtgggcctggatccgctgggtcgtgttccgatgatggcggaggaaaacctgctggcggcgaaagcgctggaggacgaagcgaaccgtgaattctaa

SEQ ID NO: 86 - protein, 1173 aa, Artificial Sequence
  SYNTHETIC FUSION PROTEN
MGSSHHHHHHELPGEFEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQTIGVNELNGRTGLSKDYPDTPEGNKALAAAIVKAFVTDRGVDGLDIDIEHEFTNKRTPEEDARALNVFKEIAQLIGKNGSDKSKLLIMQTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKDAIAHMNDNVAWFKQAKYGMMIHWGLYSLLAGEYRGESSSAYAEWIQSKFQIPNAEYGNLATAFNPLYFDAKKIVALAKQCGMQYLVVTTKHHDGFAMYHSKVDAYNVYDATPFHRDIIGELAEACQKAGLKFGLYYSQDLDWHDPNGGGYKSNDVETAGTTWDNSWDFPDEDQKNFDLCFDNKILPQIKEIMSNYGDIATAWFDVPMTLSEAQSQTIYDTVRELQPNCLINSRLGNGKYDFVSLGDNEIPKNKEDMNKTDVDYNEITGFKPSPLGLYETAGTINDSWGFSYHDQNWKTPRTLYRYKQHLNDFGINYLLNVGLDPLGRVPMMAEENLLAAKALEDEANREF

SEQ ID NO: 87 - DNA, 3522 bp, Artificial Sequence
  SYNTHETIC FUSION PROTEN
atgggcagcagccatcatcaccatcaccatgagctccccggggaattcgaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcagacaattggtgttaacgaattaaatggacgtacaggtttatctaaagattatcctgatactcctgaggggaacaaagctttagcagcagccattgtcaaggcatttgtaactgatcgtggtgtcgatggactagatattgatattgagcacgaatttacgaacaaaagaacacctgaagaagatgctcgtgctctaaatgtttttaaagagattgcgcagttaataggtaaaaatggtagtgataaatctaaattgctcatcatggaccagaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggatgcgatcgctcatatgaacgacaacgtggcgtggttcaagcaggcgaaatatggcatgatgattcactggggtctgtacagcctgctggcgggcgagtatcgtggtgaaagcagcagcgcgtacgcggagtggatccagagcaagtttcaaattccgaacgcggaatacggcaacctggcgaccgcgttcaacccgctgtattttgatgcgaagaaaatcgttgcgctggcgaaacagtgcggcatgcaatacctggtggttaccaccaagcaccacgacggtttcgcgatgtatcacagcaaagtggacgcgtacaacgtttatgatgcgaccccgtttcaccgtgatatcattggcgagctggcggaagcgtgccagaaggcgggtctgaaattcggtctgtactatagccaagacctggattggcacgacccgaacggtggcggttataagagcaacgatgtggagaccgcgggtaccacctgggacaacagctgggatttcccggacgaagatcagaaaaacttcgacctgtgctttgataacaagatcctgccgcaaatcaaagagattatgagcaactacggtgacattgcgaccgcgtggtttgatgtgccgatgaccctgagcgaggcgcagagccaaaccatctatgacaccgttcgtgaactgcaaccgaactgcctgattaacagccgtctgggcaacggcaagtacgacttcgtgagcctgggcgataacgagatcccgaagaacaaagaagatatgaacaagaccgacgttgattacaacgagattaccggcttcaaaccgagcccgctgggcctgtatgaaaccgcgggtaccatcaacgacagctggggttttagctaccacgatcagaactggaagaccccgcgtaccctgtaccgttataaacaacacctgaacgactttggtattaactacctgctgaacgtgggcctggatccgctgggtcgtgttccgatgatggcggaggaaaacctgctggcggcgaaagcgctggaggacgaagcgaaccgtgaattctaa

SEQ ID NO: 88 - protein, 1173 aa, Artificial Sequence
  SYNTHETIC FUSION PROTEN
MGSSHHHHHHELPGEFEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQTIGVNELNGRTGLSKDYPDTPEGNKALAAAIVKAFVTDRGVDGLDIDIEHEFTNKRTPEEDARALNVFKEIAQLIGKNGSDKSKLLIMDQTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKDAIAHMNDNVAWFKQAKYGMMIHWGLYSLLAGEYRGESSSAYAEWIQSKFQIPNAEYGNLATAFNPLYFDAKKIVALAKQCGMQYLVVTTKHHDGFAMYHSKVDAYNVYDATPFHRDIIGELAEACQKAGLKFGLYYSQDLDWHDPNGGGYKSNDVETAGTTWDNSWDFPDEDQKNFDLCFDNKILPQIKEIMSNYGDIATAWFDVPMTLSEAQSQTIYDTVRELQPNCLINSRLGNGKYDFVSLGDNEIPKNKEDMNKTDVDYNEITGFKPSPLGLYETAGTINDSWGFSYHDQNWKTPRTLYRYKQHLNDFGINYLLNVGLDPLGRVPMMAEENLLAAKALEDEANREF

SEQ ID NO: 89 - DNA, 2751 bp, Artificial Sequence
  SYNTHETIC FUSION PROTEN
atgggcagcagccatcatcatcatcatcacagcagcggcctggtgccgcgcggcagccatatgaacgacaacgtggcgtggttcaagcaggcgaaatatggcatgatgattcactggggtctgtacagcctgctggcgggcgagtatcgtggtgaaagcagcagcgcgtacgcggagtggatccagagcaagtttcaaattccgaacgcggaatacggcaacctggcgaccgcgttcaacccgctgtattttgatgcgaagaaaatcgttgcgctggcgaaacagtgcggcatgcaatacctggtggttaccaccaagcaccacgacggtttcgcgatgtatcacagcaaagtggacgcgtacaacgtttatgatgcgaccccgtttcaccgtgatatcattggcgagctggcggaagcgtgccagaaggcgggtctgaaattcggtctgtactatagccaagacctggattggcacgacccgaacggtggcggttataagagcaacgatgtggagaccgcgggtaccacctgggacaacagctgggatttcccggacgaagatcagaaaaacttcgacctgtgctttgataacaagatcctgccgcaaatcaaagagattatgagcaactacggtgacattgcgaccgcgtggtttgatgtgccgatgaccctgagcgaggcgcagagccaaaccatctatgacaccgttcgtgaactgcaaccgaactgcctgattaacagccgtctgggcaacggcaagtacgacttcgtgagcctgggcgataacgagatcccgaagaacaaagaagatatgaacaagaccgacgttgattacaacgagattaccggcttcaaaccgagcccgctgggcctgtatgaaaccgcgggtaccatcaacgacagctggggttttagctaccacgatcagaactggaagaccccgcgtaccctgtaccgttataaacaacacctgaacgactttggtattaactacctgctgaacgtgggcctggatccgctgggtcgtgttccgatgatggcggaggaaaacctgctggcggcgaaagcgctggaggacgaagcgaaccgtggatccaaagataagtcgtatgatctgattgatgagaaagatttcccagataaggctttgcgagaagctgtgatggcgcaggttggaaccagaaaaggtgatttggaacgtttcaatggcacattacgattggataatccagcgattcaaagtttagaaggtctaaataaatttaaaaaattagctcaattagacttgattggcttatctcgcattacaaagctcgaccgttctgttttacccgctaatatgaagccaggcaaagataccttggaaacagttcttgaaacctataaaaaggataacaaagaagaacctgctactatcccaccagtatctttgaaggtttctggtttaactggtctgaaagaattagatttgtcaggttttgaccgtgaaaccttggctggtcttgatgccgctactctaacgtctttagaaaaagttgatatttctggcaacaaacttgatttggctccaggaacagaaaatcgacaaatttttgatactatgctatcaactatcagcaatcatgttggaagcaatgaacaaacagtgaaatttgacaagcaaaaaccaactgggcattacccagatacctatgggaaaactagtctgcgcttaccagtggcaaatgaaaaagttgatttgcaaagccagcttttgtttgggactgtgacaaatcaaggaaccctaatcaatagcgaagcagactataaggcttaccaaaatcataaaattgctggacgtagctttgttgattcaaactatcattacaataactttaaagtttcttatgagaactataccgttaaagtaactgattccacattgggaaccactactgacaaaacgctagcaactgataaagaagagacctataaggttgacttctttagcccagcagataagacaaaagctgttcatactgctaaagtgattgttggtgacgaaaaaaccatgatggttaatttggcagaaggcgcaacagttattggaggaagtgctgatcctgtaaatgcaagaaaggtatttgatgggcaactgggcagtgagactgataatatctctttaggatgggattctaagcaaagtattatatttaaattgaaagaagatggattaataaagcattggcgtttcttcaatgattcagcccgaaatcctgagacaaccaataaacctattcaggaagcaagtctacaaatttttaatatcaaagattataatctagataatttgttggaaaatcccaataaatttgatgatgaaaaatattggattactgtagatacttacagtgcacaaggagagagagctactgcattcagtaatacattaaataatattactagtaaatattggcgagttgtctttgatactaaaggagatagatatagttcgccagtagtccctgaactccaaattttaggttatccgttacctaacgccgacactatcatgaaaacagtaactactgctaaagagttatctcaacaaaaagataagttttctcaaaagatgcttgatgagttaaaaataaaagagatggctttagaaacttctttgaacagtaagatttttgatgtaactgctattaatgctaatgctggagttttgaaagattgtattgagaaaaggcagctgctaaaaaaataa

SEQ ID NO: 90 - protein, 916 aa, Artificial Sequence
  SYNTHETIC FUSION PROTEN
MGSSHHHHHHSSGLVPRGSHMNDNVAWFKQAKYGMMIHWGLYSLLAGEYRGESSSAYAEWIQSKFQIPNAEYGNLATAFNPLYFDAKKIVALAKQCGMQYLVVTTKHHDGFAMYHSKVDAYNVYDATPFHRDIIGELAEACQKAGLKFGLYYSQDLDWHDPNGGGYKSNDVETAGTTWDNSWDFPDEDQKNFDLCFDNKILPQIKEIMSNYGDIATAWFDVPMTLSEAQSQTIYDTVRELQPNCLINSRLGNGKYDFVSLGDNEIPKNKEDMNKTDVDYNEITGFKPSPLGLYETAGTINDSWGFSYHDQNWKTPRTLYRYKQHLNDFGINYLLNVGLDPLGRVPMMAEENLLAAKALEDEANRGSKDKSYDLIDEKDFPDKALREAVMAQVGTRKGDLERFNGTLRLDNPAIQSLEGLNKFKKLAQLDLIGLSRITKLDRSVLPANMKPGKDTLETVLETYKKDNKEEPATIPPVSLKVSGLTGLKELDLSGFDRETLAGLDAATLTSLEKVDISGNKLDLAPGTENRQIFDTMLSTISNHVGSNEQTVKFDKQKPTGHYPDTYGKTSLRLPVANEKVDLQSQLLFGTVTNQGTLINSEADYKAYQNHKIAGRSFVDSNYHYNNFKVSYENYTVKVTDSTLGTTTDKTLATDKEETYKVDFFSPADKTKAVHTAKVIVGDEKTMMVNLAEGATVIGGSADPVNARKVFDGQLGSETDNISLGWDSKQSIIFKLKEDGLIKHWRFFNDSARNPETTNKPIQEASLQIFNIKDYNLDNLLENPNKFDDEKYWITVDTYSAQGERATAFSNTLNNITSKYWRVVFDTKGDRYSSPVVPELQILGYPLPNADTIMKTVTTAKELSQQKDKFSQKMLDELKIKEMALETSLNSKIFDVTAINANAGVLKDCIEKRQLLKK

SEQ ID NO: 91 - DNA, 2478 bp, Artificial Sequence
  SYNTHETIC FUSION PROTEN
atgggcagcagccatcatcatcatcatcacagcagcggcctggtgccgcgcggcagccatatgaacgacaacgtggcgtggttcaagcaggcgaaatatggcatgatgattcactggggtctgtacagcctgctggcgggcgagtatcgtggtgaaagcagcagcgcgtacgcggagtggatccagagcaagtttcaaattccgaacgcggaatacggcaacctggcgaccgcgttcaacccgctgtattttgatgcgaagaaaatcgttgcgctggcgaaacagtgcggcatgcaatacctggtggttaccaccaagcaccacgacggtttcgcgatgtatcacagcaaagtggacgcgtacaacgtttatgatgcgaccccgtttcaccgtgatatcattggcgagctggcggaagcgtgccagaaggcgggtctgaaattcggtctgtactatagccaagacctggattggcacgacccgaacggtggcggttataagagcaacgatgtggagaccgcgggtaccacctgggacaacagctgggatttcccggacgaagatcagaaaaacttcgacctgtgctttgataacaagatcctgccgcaaatcaaagagattatgagcaactacggtgacattgcgaccgcgtggtttgatgtgccgatgaccctgagcgaggcgcagagccaaaccatctatgacaccgttcgtgaactgcaaccgaactgcctgattaacagccgtctgggcaacggcaagtacgacttcgtgagcctgggcgataacgagatcccgaagaacaaagaagatatgaacaagaccgacgttgattacaacgagattaccggcttcaaaccgagcccgctgggcctgtatgaaaccgcgggtaccatcaacgacagctggggttttagctaccacgatcagaactggaagaccccgcgtaccctgtaccgttataaacaacacctgaacgactttggtattaactacctgctgaacgtgggcctggatccgctgggtcgtgttccgatgatggcggaggaaaacctgctggcggcgaaagcgctggaggacgaagcgaaccgtggatccaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggattaa

SEQ ID NO: 92 - protein, 825 aa, Artificial Sequence
  SYNTHETIC FUSION PROTEN
MGSSHHHHHHSSGLVPRGSHMNDNVAWFKQAKYGMMIHWGLYSLLAGEYRGESSSAYAEWIQSKFQIPNAEYGNLATAFNPLYFDAKKIVALAKQCGMQYLVVTTKHHDGFAMYHSKVDAYNVYDATPFHRDIIGELAEACQKAGLKFGLYYSQDLDWHDPNGGGYKSNDVETAGTTWDNSWDFPDEDQKNFDLCFDNKILPQIKEIMSNYGDIATAWFDVPMTLSEAQSQTIYDTVRELQPNCLINSRLGNGKYDFVSLGDNEIPKNKEDMNKTDVDYNEITGFKPSPLGLYETAGTINDSWGFSYHDQNWKTPRTLYRYKQHLNDFGINYLLNVGLDPLGRVPMMAEENLLAAKALEDEANRGSTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKD

SEQ ID NO: 93 - DNA, 4011 bp, Artificial Sequence
  SYNTHETIC FUSION PROTEN
atgggcagcagccatcatcatcatcatcacagcagcggcctggtgccgcgcggcagccatatgaacgacaacgtggcgtggttcaagcaggcgaaatatggcatgatgattcactggggtctgtacagcctgctggcgggcgagtatcgtggtgaaagcagcagcgcgtacgcggagtggatccagagcaagtttcaaattccgaacgcggaatacggcaacctggcgaccgcgttcaacccgctgtattttgatgcgaagaaaatcgttgcgctggcgaaacagtgcggcatgcaatacctggtggttaccaccaagcaccacgacggtttcgcgatgtatcacagcaaagtggacgcgtacaacgtttatgatgcgaccccgtttcaccgtgatatcattggcgagctggcggaagcgtgccagaaggcgggtctgaaattcggtctgtactatagccaagacctggattggcacgacccgaacggtggcggttataagagcaacgatgtggagaccgcgggtaccacctgggacaacagctgggatttcccggacgaagatcagaaaaacttcgacctgtgctttgataacaagatcctgccgcaaatcaaagagattatgagcaactacggtgacattgcgaccgcgtggtttgatgtgccgatgaccctgagcgaggcgcagagccaaaccatctatgacaccgttcgtgaactgcaaccgaactgcctgattaacagccgtctgggcaacggcaagtacgacttcgtgagcctgggcgataacgagatcccgaagaacaaagaagatatgaacaagaccgacgttgattacaacgagattaccggcttcaaaccgagcccgctgggcctgtatgaaaccgcgggtaccatcaacgacagctggggttttagctaccacgatcagaactggaagaccccgcgtaccctgtaccgttataaacaacacctgaacgactttggtattaactacctgctgaacgtgggcctggatccgctgggtcgtgttccgatgatggcggaggaaaacctgctggcggcgaaagcgctggaggacgaagcgaaccgtggatccacccaccatgattcactcaatactgtaaaagcggaggagaagactgttcaggttcagaaaggattaccttctatcgatagcttgcattatctgtcagagaatagcaaaaaagaatttaaagaagaactctcaaaagcggggcaagaatctcaaaaggtcaaagagatattagcaaaagctcagcaggcagataaacaagctcaagaacttgccaaaatgaaaattcctgagaaaataccgatgaaaccgttacatggttctctctacggtggttactttagaacttggcatgacaaaacatcagatccaacagaaaaagacaaagttaactcgatgggagagcttcctaaagaagtagatctagcctttattttccacgattggacaaaagattatagccttttttggaaagaattggccaccaaacatgtgccaaagttaaacaagcaagggacacgtgtcattcgtaccattccatggcgtttcctagctgggggtgataacagtggtattgcagaagataccagtaaatacccaaatacaccagagggaaataaagctttagccaaagctattgttgatgaatatgtttataaatacaaccttgatggcttagatgtggatgttgaacatgatagtattccaaaagttgacaaaaaagaagatacagcaggcgtagaacgctctattcaagtgtttgaagaaattgggaaattaattggaccaaaaggtgttgataaatcgcggttatttattatggatagcacctacatggctgataaaaacccattgattgagcgaggagctccttatattaatttattactggtacaggtctatggttcacaaggagagaaaggtggttgggagcctgtttctaatcgacctgaaaaaacaatggaagaacgatggcaaggttatagcaagtatattcgtcctgaacaatacatgattggtttttctttctatgaggaaaatgctcaagaagggaatctttggtatgatattaattctcgcaaggacgaggacaaagcaaatggaattaacactgacataactggaacgcgtgccgaacggtatgcaaggtggcaacctaagacaggtggggttaagggaggtatcttctcctacgctattgaccgagatggtgtagctcatcaacctaaaaaatatgctaaacagaaagagtttaaggacgcaactgataacatcttccactcagattatagtgtctccaaggcattaaagacagttatgctaaaagataagtcgtatgatctgattgatgagaaagatttcccagataaggctttgcgagaagctgtgatggcgcaggttggaaccagaaaaggtgatttggaacgtttcaatggcacattacgattggataatccagcgattcaaagtttagaaggtctaaataaatttaaaaaattagctcaattagacttgattggcttatctcgcattacaaagctcgaccgttctgttttacccgctaatatgaagccaggcaaagataccttggaaacagttcttgaaacctataaaaaggataacaaagaagaacctgctactatcccaccagtatctttgaaggtttctggtttaactggtctgaaagaattagatttgtcaggttttgaccgtgaaaccttggctggtcttgatgccgctactctaacgtctttagaaaaagttgatatttctggcaacaaacttgatttggctccaggaacagaaaatcgacaaatttttgatactatgctatcaactatcagcaatcatgttggaagcaatgaacaaacagtgaaatttgacaagcaaaaaccaactgggcattacccagatacctatgggaaaactagtctgcgcttaccagtggcaaatgaaaaagttgatttgcaaagccagcttttgtttgggactgtgacaaatcaaggaaccctaatcaatagcgaagcagactataaggcttaccaaaatcataaaattgctggacgtagctttgttgattcaaactatcattacaataactttaaagtttcttatgagaactataccgttaaagtaactgattccacattgggaaccactactgacaaaacgctagcaactgataaagaagagacctataaggttgacttctttagcccagcagataagacaaaagctgttcatactgctaaagtgattgttggtgacgaaaaaaccatgatggttaatttggcagaaggcgcaacagttattggaggaagtgctgatcctgtaaatgcaagaaaggtatttgatgggcaactgggcagtgagactgataatatctctttaggatgggattctaagcaaagtattatatttaaattgaaagaagatggattaataaagcattggcgtttcttcaatgattcagcccgaaatcctgagacaaccaataaacctattcaggaagcaagtctacaaatttttaatatcaaagattataatctagataatttgttggaaaatcccaataaatttgatgatgaaaaatattggattactgtagatacttacagtgcacaaggagagagagctactgcattcagtaatacattaaataatattactagtaaatattggcgagttgtctttgatactaaaggagatagatatagttcgccagtagtccctgaactccaaattttaggttatccgttacctaacgccgacactatcatgaaaacagtaactactgctaaagagttatctcaacaaaaagataagttttctcaaaagatgcttgatgagttaaaaataaaagagatggctttagaaacttctttgaacagtaagatttttgatgtaactgctattaatgctaatgctggagttttgaaagattgtattgagaaaaggcagctgctaaaaaaataa

SEQ ID NO: 94 - protein, 1336 aa, Artificial Sequence
  SYNTHETIC FUSION PROTEN
MGSSHHHHHHSSGLVPRGSHMNDNVAWFKQAKYGMMIHWGLYSLLAGEYRGESSSAYAEWIQSKFQIPNAEYGNLATAFNPLYFDAKKIVALAKQCGMQYLVVTTKHHDGFAMYHSKVDAYNVYDATPFHRDIIGELAEACQKAGLKFGLYYSQDLDWHDPNGGGYKSNDVETAGTTWDNSWDFPDEDQKNFDLCFDNKILPQIKEIMSNYGDIATAWFDVPMTLSEAQSQTIYDTVRELQPNCLINSRLGNGKYDFVSLGDNEIPKNKEDMNKTDVDYNEITGFKPSPLGLYETAGTINDSWGFSYHDQNWKTPRTLYRYKQHLNDFGINYLLNVGLDPLGRVPMMAEENLLAAKALEDEANRGSTHHDSLNTVKAEEKTVQVQKGLPSIDSLHYLSENSKKEFKEELSKAGQESQKVKEILAKAQQADKQAQELAKMKIPEKIPMKPLHGSLYGGYFRTWHDKTSDPTEKDKVNSMGELPKEVDLAFIFHDWTKDYSLFWKELATKHVPKLNKQGTRVIRTIPWRFLAGGDNSGIAEDTSKYPNTPEGNKALAKAIVDEYVYKYNLDGLDVDVEHDSIPKVDKKEDTAGVERSIQVFEEIGKLIGPKGVDKSRLFIMDSTYMADKNPLIERGAPYINLLLVQVYGSQGEKGGWEPVSNRPEKTMEERWQGYSKYIRPEQYMIGFSFYEENAQEGNLWYDINSRKDEDKANGINTDITGTRAERYARWQPKTGGVKGGIFSYAIDRDGVAHQPKKYAKQKEFKDATDNIFHSDYSVSKALKTVMLKDKSYDLIDEKDFPDKALREAVMAQVGTRKGDLERFNGTLRLDNPAIQSLEGLNKFKKLAQLDLIGLSRITKLDRSVLPANMKPGKDTLETVLETYKKDNKEEPATIPPVSLKVSGLTGLKELDLSGFDRETLAGLDAATLTSLEKVDISGNKLDLAPGTENRQIFDTMLSTISNHVGSNEQTVKFDKQKPTGHYPDTYGKTSLRLPVANEKVDLQSQLLFGTVTNQGTLINSEADYKAYQNHKIAGRSFVDSNYHYNNFKVSYENYTVKVTDSTLGTTTDKTLATDKEETYKVDFFSPADKTKAVHTAKVIVGDEKTMMVNLAEGATVIGGSADPVNARKVFDGQLGSETDNISLGWDSKQSIIFKLKEDGLIKHWRFFNDSARNPETTNKPIQEASLQIFNIKDYNLDNLLENPNKFDDEKYWITVDTYSAQGERATAFSNTLNNITSKYWRVVFDTKGDRYSSPVVPELQILGYPLPNADTIMKTVTTAKELSQQKDKFSQKMLDELKIKEMALETSLNSKIFDVTAINANAGVLKDCIEKRQLLKK

SEQ ID NO: 95 - DNA, 4011 bp, Artificial Sequence
  SYNTHETIC FUSION PROTEN
atgggcagcagccatcatcatcatcatcacagcagcggcctggtgccgcgcggcagccatatgaacgacaacgtggcgtggttcaagcaggcgaaatatggcatgatgattcactggggtctgtacagcctgctggcgggcgagtatcgtggtgaaagcagcagcgcgtacgcggagtggatccagagcaagtttcaaattccgaacgcggaatacggcaacctggcgaccgcgttcaacccgctgtattttgatgcgaagaaaatcgttgcgctggcgaaacagtgcggcatgcaatacctggtggttaccaccaagcaccacgacggtttcgcgatgtatcacagcaaagtggacgcgtacaacgtttatgatgcgaccccgtttcaccgtgatatcattggcgagctggcggaagcgtgccagaaggcgggtctgaaattcggtctgtactatagccaagacctggattggcacgacccgaacggtggcggttataagagcaacgatgtggagaccgcgggtaccacctgggacaacagctgggatttcccggacgaagatcagaaaaacttcgacctgtgctttgataacaagatcctgccgcaaatcaaagagattatgagcaactacggtgacattgcgaccgcgtggtttgatgtgccgatgaccctgagcgaggcgcagagccaaaccatctatgacaccgttcgtgaactgcaaccgaactgcctgattaacagccgtctgggcaacggcaagtacgacttcgtgagcctgggcgataacgagatcccgaagaacaaagaagatatgaacaagaccgacgttgattacaacgagattaccggcttcaaaccgagcccgctgggcctgtatgaaaccgcgggtaccatcaacgacagctggggttttagctaccacgatcagaactggaagaccccgcgtaccctgtaccgttataaacaacacctgaacgactttggtattaactacctgctgaacgtgggcctggatccgctgggtcgtgttccgatgatggcggaggaaaacctgctggcggcgaaagcgctggaggacgaagcgaaccgtggatccacccaccatgattcactcaatactgtaaaagcggaggagaagactgttcaggttcagaaaggattaccttctatcgatagcttgcattatctgtcagagaatagcaaaaaagaatttaaagaagaactctcaaaagcggggcaagaatctcaaaaggtcaaagagatattagcaaaagctcagcaggcagataaacaagctcaagaacttgccaaaatgaaaattcctgagaaaataccgatgaaaccgttacatggttctctctacggtggttactttagaacttggcatgacaaaacatcagatccaacagaaaaagacaaagttaactcgatgggagagcttcctaaagaagtagatctagcctttattttccacgattggacaaaagattatagccttttttggaaagaattggccaccaaacatgtgccaaagttaaacaagcaagggacacgtgtcattcgtaccattccatggcgtttcctagctgggggtgataacagtggtattgcagaagataccagtaaatacccaaatacaccagagggaaataaagctttagccaaagctattgttgatgaatatgtttataaatacaaccttgatggcttagatgtgcaggttgaacatgatagtattccaaaagttgacaaaaaagaagatacagcaggcgtagaacgctctattcaagtgtttgaagaaattgggaaattaattggaccaaaaggtgttgataaatcgcggttatttattatggatagcacctacatggctgataaaaacccattgattgagcgaggagctccttatattaatttattactggtacaggtctatggttcacaaggagagaaaggtggttgggagcctgtttctaatcgacctgaaaaaacaatggaagaacgatggcaaggttatagcaagtatattcgtcctgaacaatacatgattggtttttctttctatgaggaaaatgctcaagaagggaatctttggtatgatattaattctcgcaaggacgaggacaaagcaaatggaattaacactgacataactggaacgcgtgccgaacggtatgcaaggtggcaacctaagacaggtggggttaagggaggtatcttctcctacgctattgaccgagatggtgtagctcatcaacctaaaaaatatgctaaacagaaagagtttaaggacgcaactgataacatcttccactcagattatagtgtctccaaggcattaaagacagttatgctaaaagataagtcgtatgatctgattgatgagaaagatttcccagataaggctttgcgagaagctgtgatggcgcaggttggaaccagaaaaggtgatttggaacgtttcaatggcacattacgattggataatccagcgattcaaagtttagaaggtctaaataaatttaaaaaattagctcaattagacttgattggcttatctcgcattacaaagctcgaccgttctgttttacccgctaatatgaagccaggcaaagataccttggaaacagttcttgaaacctataaaaaggataacaaagaagaacctgctactatcccaccagtatctttgaaggtttctggtttaactggtctgaaagaattagatttgtcaggttttgaccgtgaaaccttggctggtcttgatgccgctactctaacgtctttagaaaaagttgatatttctggcaacaaacttgatttggctccaggaacagaaaatcgacaaatttttgatactatgctatcaactatcagcaatcatgttggaagcaatgaacaaacagtgaaatttgacaagcaaaaaccaactgggcattacccagatacctatgggaaaactagtctgcgcttaccagtggcaaatgaaaaagttgatttgcaaagccagcttttgtttgggactgtgacaaatcaaggaaccctaatcaatagcgaagcagactataaggcttaccaaaatcataaaattgctggacgtagctttgttgattcaaactatcattacaataactttaaagtttcttatgagaactataccgttaaagtaactgattccacattgggaaccactactgacaaaacgctagcaactgataaagaagagacctataaggttgacttctttagcccagcagataagacaaaagctgttcatactgctaaagtgattgttggtgacgaaaaaaccatgatggttaatttggcagaaggcgcaacagttattggaggaagtgctgatcctgtaaatgcaagaaaggtatttgatgggcaactgggcagtgagactgataatatctctttaggatgggattctaagcaaagtattatatttaaattgaaagaagatggattaataaagcattggcgtttcttcaatgattcagcccgaaatcctgagacaaccaataaacctattcaggaagcaagtctacaaatttttaatatcaaagattataatctagataatttgttggaaaatcccaataaatttgatgatgaaaaatattggattactgtagatacttacagtgcacaaggagagagagctactgcattcagtaatacattaaataatattactagtaaatattggcgagttgtctttgatactaaaggagatagatatagttcgccagtagtccctgaactccaaattttaggttatccgttacctaacgccgacactatcatgaaaacagtaactactgctaaagagttatctcaacaaaaagataagttttctcaaaagatgcttgatgagttaaaaataaaagagatggctttagaaacttctttgaacagtaagatttttgatgtaactgctattaatgctaatgctggagttttgaaagattgtattgagaaaaggcagctgctaaaaaaataa

SEQ ID NO: 96 - protein, 1336 aa, Artificial Sequence
  SYNTHETIC FUSION PROTEN
MGSSHHHHHHSSGLVPRGSHMNDNVAWFKQAKYGMMIHWGLYSLLAGEYRGESSSAYAEWIQSKFQIPNAEYGNLATAFNPLYFDAKKIVALAKQCGMQYLVVTTKHHDGFAMYHSKVDAYNVYDATPFHRDIIGELAEACQKAGLKFGLYYSQDLDWHDPNGGGYKSNDVETAGTTWDNSWDFPDEDQKNFDLCFDNKILPQIKEIMSNYGDIATAWFDVPMTLSEAQSQTIYDTVRELQPNCLINSRLGNGKYDFVSLGDNEIPKNKEDMNKTDVDYNEITGFKPSPLGLYETAGTINDSWGFSYHDQNWKTPRTLYRYKQHLNDFGINYLLNVGLDPLGRVPMMAEENLLAAKALEDEANRGSTHHDSLNTVKAEEKTVQVQKGLPSIDSLHYLSENSKKEFKEELSKAGQESQKVKEILAKAQQADKQAQELAKMKIPEKIPMKPLHGSLYGGYFRTWHDKTSDPTEKDKVNSMGELPKEVDLAFIFHDWTKDYSLFWKELATKHVPKLNKQGTRVIRTIPWRFLAGGDNSGIAEDTSKYPNTPEGNKALAKAIVDEYVYKYNLDGLDVQVEHDSIPKVDKKEDTAGVERSIQVFEEIGKLIGPKGVDKSRLFIMDSTYMADKNPLIERGAPYINLLLVQVYGSQGEKGGWEPVSNRPEKTMEERWQGYSKYIRPEQYMIGFSFYEENAQEGNLWYDINSRKDEDKANGINTDITGTRAERYARWQPKTGGVKGGIFSYAIDRDGVAHQPKKYAKQKEFKDATDNIFHSDYSVSKALKTVMLKDKSYDLIDEKDFPDKALREAVMAQVGTRKGDLERFNGTLRLDNPAIQSLEGLNKFKKLAQLDLIGLSRITKLDRSVLPANMKPGKDTLETVLETYKKDNKEEPATIPPVSLKVSGLTGLKELDLSGFDRETLAGLDAATLTSLEKVDISGNKLDLAPGTENRQIFDTMLSTISNHVGSNEQTVKFDKQKPTGHYPDTYGKTSLRLPVANEKVDLQSQLLFGTVTNQGTLINSEADYKAYQNHKIAGRSFVDSNYHYNNFKVSYENYTVKVTDSTLGTTTDKTLATDKEETYKVDFFSPADKTKAVHTAKVIVGDEKTMMVNLAEGATVIGGSADPVNARKVFDGQLGSETDNISLGWDSKQSIIFKLKEDGLIKHWRFFNDSARNPETTNKPIQEASLQIFNIKDYNLDNLLENPNKFDDEKYWITVDTYSAQGERATAFSNTLNNITSKYWRVVFDTKGDRYSSPVVPELQILGYPLPNADTIMKTVTTAKELSQQKDKFSQKMLDELKIKEMALETSLNSKIFDVTAINANAGVLKDCIEKRQLLKK

SEQ ID NO: 97 - DNA, 3552 bp, Artificial Sequence
  SYNTHETIC FUSION PROTEN
atgggcagcagccatcatcaccatcaccatgagctccccgggccgcgggaaaacctgtattttcagggagcgatcgctcatatgaacgacaacgtggcgtggttcaagcaggcgaaatatggcatgatgattcactggggtctgtacagcctgctggcgggcgagtatcgtggtgaaagcagcagcgcgtacgcggagtggatccagagcaagtttcaaattccgaacgcggaatacggcaacctggcgaccgcgttcaacccgctgtattttgatgcgaagaaaatcgttgcgctggcgaaacagtgcggcatgcaatacctggtggttaccaccaagcaccacgacggtttcgcgatgtatcacagcaaagtggacgcgtacaacgtttatgatgcgaccccgtttcaccgtgatatcattggcgagctggcggaagcgtgccagaaggcgggtctgaaattcggtctgtactatagccaagacctggattggcacgacccgaacggtggcggttataagagcaacgatgtggagaccgcgggtaccacctgggacaacagctgggatttcccggacgaagatcagaaaaacttcgacctgtgctttgataacaagatcctgccgcaaatcaaagagattatgagcaactacggtgacattgcgaccgcgtggtttgatgtgccgatgaccctgagcgaggcgcagagccaaaccatctatgacaccgttcgtgaactgcaaccgaactgcctgattaacagccgtctgggcaacggcaagtacgacttcgtgagcctgggcgataacgagatcccgaagaacaaagaagatatgaacaagaccgacgttgattacaacgagattaccggcttcaaaccgagcccgctgggcctgtatgaaaccgcgggtaccatcaacgacagctggggttttagctaccacgatcagaactggaagaccccgcgtaccctgtaccgttataaacaacacctgaacgactttggtattaactacctgctgaacgtgggcctggatccgctgggtcgtgttccgatgatggcggaggaaaacctgctggcggcgaaagcgctggaggacgaagcgaaccgtgaattcgaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcagacaattggtgttaacgaattaaatggacgtacaggtttatctaaagattatcctgatactcctgaggggaacaaagctttagcagcagccattgtcaaggcatttgtaactgatcgtggtgtcgatggactagatattgatattgagcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggatgcgatcgcttaa

SEQ ID NO: 98 - protein, 1183 aa, Artificial Sequence
  SYNTHETIC FUSION PROTEN
MGSSHHHHHHELPGPRENLYFQGAIAHMNDNVAWFKQAKYGMMIHWGLYSLLAGEYRGESSSAYAEWIQSKFQIPNAEYGNLATAFNPLYFDAKKIVALAKQCGMQYLVVTTKHHDGFAMYHSKVDAYNVYDATPFHRDIIGELAEACQKAGLKFGLYYSQDLDWHDPNGGGYKSNDVETAGTTWDNSWDFPDEDQKNFDLCFDNKILPQIKEIMSNYGDIATAWFDVPMTLSEAQSQTIYDTVRELQPNCLINSRLGNGKYDFVSLGDNEIPKNKEDMNKTDVDYNEITGFKPSPLGLYETAGTINDSWGFSYHDQNWKTPRTLYRYKQHLNDFGINYLLNVGLDPLGRVPMMAEENLLAAKALEDEANREFEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQTIGVNELNGRTGLSKDYPDTPEGNKALAAAIVKAFVTDRGVDGLDIDIEHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKDAIA

SEQ ID NO: 99 - DNA, 3552 bp, Artificial Sequence
  SYNTHETIC FUSION PROTEN
atgggcagcagccatcatcaccatcaccatgagctccccgggccgcgggaaaacctgtattttcagggagcgatcgctcatatgaacgacaacgtggcgtggttcaagcaggcgaaatatggcatgatgattcactggggtctgtacagcctgctggcgggcgagtatcgtggtgaaagcagcagcgcgtacgcggagtggatccagagcaagtttcaaattccgaacgcggaatacggcaacctggcgaccgcgttcaacccgctgtattttgatgcgaagaaaatcgttgcgctggcgaaacagtgcggcatgcaatacctggtggttaccaccaagcaccacgacggtttcgcgatgtatcacagcaaagtggacgcgtacaacgtttatgatgcgaccccgtttcaccgtgatatcattggcgagctggcggaagcgtgccagaaggcgggtctgaaattcggtctgtactatagccaagacctggattggcacgacccgaacggtggcggttataagagcaacgatgtggagaccgcgggtaccacctgggacaacagctgggatttcccggacgaagatcagaaaaacttcgacctgtgctttgataacaagatcctgccgcaaatcaaagagattatgagcaactacggtgacattgcgaccgcgtggtttgatgtgccgatgaccctgagcgaggcgcagagccaaaccatctatgacaccgttcgtgaactgcaaccgaactgcctgattaacagccgtctgggcaacggcaagtacgacttcgtgagcctgggcgataacgagatcccgaagaacaaagaagatatgaacaagaccgacgttgattacaacgagattaccggcttcaaaccgagcccgctgggcctgtatgaaaccgcgggtaccatcaacgacagctggggttttagctaccacgatcagaactggaagaccccgcgtaccctgtaccgttataaacaacacctgaacgactttggtattaactacctgctgaacgtgggcctggatccgctgggtcgtgttccgatgatggcggaggaaaacctgctggcggcgaaagcgctggaggacgaagcgaaccgtgaattcgaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcagacaattggtgttaacgaattaaatggacgtacaggtttatctaaagattatcctgatactcctgaggggaacaaagctttagcagcagccattgtcaaggcatttgtaactgatcgtggtgtcgatggactagatattatgattgagcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggatgcgatcgcttaa

SEQ ID NO: 100 - protein, 1183 aa, Artificial Sequence
  SYNTHETIC FUSION PROTEN
MGSSHHHHHHELPGPRENLYFQGAIAHMNDNVAWFKQAKYGMMIHWGLYSLLAGEYRGESSSAYAEWIQSKFQIPNAEYGNLATAFNPLYFDAKKIVALAKQCGMQYLVVTTKHHDGFAMYHSKVDAYNVYDATPFHRDIIGELAEACQKAGLKFGLYYSQDLDWHDPNGGGYKSNDVETAGTTWDNSWDFPDEDQKNFDLCFDNKILPQIKEIMSNYGDIATAWFDVPMTLSEAQSQTIYDTVRELQPNCLINSRLGNGKYDFVSLGDNEIPKNKEDMNKTDVDYNEITGFKPSPLGLYETAGTINDSWGFSYHDQNWKTPRTLYRYKQHLNDFGINYLLNVGLDPLGRVPMMAEENLLAAKALEDEANREFEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQTIGVNELNGRTGLSKDYPDTPEGNKALAAAIVKAFVTDRGVDGLDIMIEHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKDAIA

SEQ ID NO: 101 - DNA, 3552 bp, Artificial Sequence
  SYNTHETIC FUSION PROTEN
atgggcagcagccatcatcaccatcaccatgagctccccgggccgcgggaaaacctgtattttcagggagcgatcgctcatatgaacgacaacgtggcgtggttcaagcaggcgaaatatggcatgatgattcactggggtctgtacagcctgctggcgggcgagtatcgtggtgaaagcagcagcgcgtacgcggagtggatccagagcaagtttcaaattccgaacgcggaatacggcaacctggcgaccgcgttcaacccgctgtattttgatgcgaagaaaatcgttgcgctggcgaaacagtgcggcatgcaatacctggtggttaccaccaagcaccacgacggtttcgcgatgtatcacagcaaagtggacgcgtacaacgtttatgatgcgaccccgtttcaccgtgatatcattggcgagctggcggaagcgtgccagaaggcgggtctgaaattcggtctgtactatagccaagacctggattggcacgacccgaacggtggcggttataagagcaacgatgtggagaccgcgggtaccacctgggacaacagctgggatttcccggacgaagatcagaaaaacttcgacctgtgctttgataacaagatcctgccgcaaatcaaagagattatgagcaactacggtgacattgcgaccgcgtggtttgatgtgccgatgaccctgagcgaggcgcagagccaaaccatctatgacaccgttcgtgaactgcaaccgaactgcctgattaacagccgtctgggcaacggcaagtacgacttcgtgagcctgggcgataacgagatcccgaagaacaaagaagatatgaacaagaccgacgttgattacaacgagattaccggcttcaaaccgagcccgctgggcctgtatgaaaccgcgggtaccatcaacgacagctggggttttagctaccacgatcagaactggaagaccccgcgtaccctgtaccgttataaacaacacctgaacgactttggtattaactacctgctgaacgtgggcctggatccgctgggtcgtgttccgatgatggcggaggaaaacctgctggcggcgaaagcgctggaggacgaagcgaaccgtgaattcgaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcagacaattggtgttaacgaattaaatggacgtacaggtttatctaaagattatcctgatactcctgaggggaacaaagctttagcagcagccattgtcaaggcatttgtaactgatcgtggtgtcgatggactagatattcagattgagcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggatgcgatcgcttaa

SEQ ID NO: 102 - protein, 1183 aa, Artificial Sequence
  SYNTHETIC FUSION PROTEN
MGSSHHHHHHELPGPRENLYFQGAIAHMNDNVAWFKQAKYGMMIHWGLYSLLAGEYRGESSSAYAEWIQSKFQIPNAEYGNLATAFNPLYFDAKKIVALAKQCGMQYLVVTTKHHDGFAMYHSKVDAYNVYDATPFHRDIIGELAEACQKAGLKFGLYYSQDLDWHDPNGGGYKSNDVETAGTTWDNSWDFPDEDQKNFDLCFDNKILPQIKEIMSNYGDIATAWFDVPMTLSEAQSQTIYDTVRELQPNCLINSRLGNGKYDFVSLGDNEIPKNKEDMNKTDVDYNEITGFKPSPLGLYETAGTINDSWGFSYHDQNWKTPRTLYRYKQHLNDFGINYLLNVGLDPLGRVPMMAEENLLAAKALEDEANREFEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQTIGVNELNGRTGLSKDYPDTPEGNKALAAAIVKAFVTDRGVDGLDIQIEHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKDAIA

SEQ ID NO: 103 - DNA, 3552 bp, Artificial Sequence
  SYNTHETIC FUSION PROTEN
atgggcagcagccatcatcaccatcaccatgagctccccgggccgcgggaaaacctgtattttcagggagcgatcgctcatatgaacgacaacgtggcgtggttcaagcaggcgaaatatggcatgatgattcactggggtctgtacagcctgctggcgggcgagtatcgtggtgaaagcagcagcgcgtacgcggagtggatccagagcaagtttcaaattccgaacgcggaatacggcaacctggcgaccgcgttcaacccgctgtattttgatgcgaagaaaatcgttgcgctggcgaaacagtgcggcatgcaatacctggtggttaccaccaagcaccacgacggtttcgcgatgtatcacagcaaagtggacgcgtacaacgtttatgatgcgaccccgtttcaccgtgatatcattggcgagctggcggaagcgtgccagaaggcgggtctgaaattcggtctgtactatagccaagacctggattggcacgacccgaacggtggcggttataagagcaacgatgtggagaccgcgggtaccacctgggacaacagctgggatttcccggacgaagatcagaaaaacttcgacctgtgctttgataacaagatcctgccgcaaatcaaagagattatgagcaactacggtgacattgcgaccgcgtggtttgatgtgccgatgaccctgagcgaggcgcagagccaaaccatctatgacaccgttcgtgaactgcaaccgaactgcctgattaacagccgtctgggcaacggcaagtacgacttcgtgagcctgggcgataacgagatcccgaagaacaaagaagatatgaacaagaccgacgttgattacaacgagattaccggcttcaaaccgagcccgctgggcctgtatgaaaccgcgggtaccatcaacgacagctggggttttagctaccacgatcagaactggaagaccccgcgtaccctgtaccgttataaacaacacctgaacgactttggtattaactacctgctgaacgtgggcctggatccgctgggtcgtgttccgatgatggcggaggaaaacctgctggcggcgaaagcgctggaggacgaagcgaaccgtgaattcgaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcagacaattggtgttaacgaattaaatggacgtacaggtttatctaaagattatcctgatactcctgaggggaacaaagctttagcagcagccattgtcaaggcatttgtaactgatcgtggtgtcgatggactagatattaccattgagcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggatgcgatcgcttaa

SEQ ID NO: 104 - protein, 1183 aa, Artificial Sequence
  SYNTHETIC FUSION PROTEN
MGSSHHHHHHELPGPRENLYFQGAIAHMNDNVAWFKQAKYGMMIHWGLYSLLAGEYRGESSSAYAEWIQSKFQIPNAEYGNLATAFNPLYFDAKKIVALAKQCGMQYLVVTTKHHDGFAMYHSKVDAYNVYDATPFHRDIIGELAEACQKAGLKFGLYYSQDLDWHDPNGGGYKSNDVETAGTTWDNSWDFPDEDQKNFDLCFDNKILPQIKEIMSNYGDIATAWFDVPMTLSEAQSQTIYDTVRELQPNCLINSRLGNGKYDFVSLGDNEIPKNKEDMNKTDVDYNEITGFKPSPLGLYETAGTINDSWGFSYHDQNWKTPRTLYRYKQHLNDFGINYLLNVGLDPLGRVPMMAEENLLAAKALEDEANREFEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQTIGVNELNGRTGLSKDYPDTPEGNKALAAAIVKAFVTDRGVDGLDITIEHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKDAIA

SEQ ID NO: 105 - DNA, 3552 bp, Artificial Sequence
  SYNTHETIC FUSION PROTEN
atgggcagcagccatcatcaccatcaccatgagctccccgggccgcgggaaaacctgtattttcagggagcgatcgctcatatgaacgacaacgtggcgtggttcaagcaggcgaaatatggcatgatgattcactggggtctgtacagcctgctggcgggcgagtatcgtggtgaaagcagcagcgcgtacgcggagtggatccagagcaagtttcaaattccgaacgcggaatacggcaacctggcgaccgcgttcaacccgctgtattttgatgcgaagaaaatcgttgcgctggcgaaacagtgcggcatgcaatacctggtggttaccaccaagcaccacgacggtttcgcgatgtatcacagcaaagtggacgcgtacaacgtttatgatgcgaccccgtttcaccgtgatatcattggcgagctggcggaagcgtgccagaaggcgggtctgaaattcggtctgtactatagccaagacctggattggcacgacccgaacggtggcggttataagagcaacgatgtggagaccgcgggtaccacctgggacaacagctgggatttcccggacgaagatcagaaaaacttcgacctgtgctttgataacaagatcctgccgcaaatcaaagagattatgagcaactacggtgacattgcgaccgcgtggtttgatgtgccgatgaccctgagcgaggcgcagagccaaaccatctatgacaccgttcgtgaactgcaaccgaactgcctgattaacagccgtctgggcaacggcaagtacgacttcgtgagcctgggcgataacgagatcccgaagaacaaagaagatatgaacaagaccgacgttgattacaacgagattaccggcttcaaaccgagcccgctgggcctgtatgaaaccgcgggtaccatcaacgacagctggggttttagctaccacgatcagaactggaagaccccgcgtaccctgtaccgttataaacaacacctgaacgactttggtattaactacctgctgaacgtgggcctggatccgctgggtcgtgttccgatgatggcggaggaaaacctgctggcggcgaaagcgctggaggacgaagcgaaccgtgaattcgaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcagacaattggtgttaacgaattaaatggacgtacaggtttatctaaagattatcctgatactcctgaggggaacaaagctttagcagcagccattgtcaaggcatttgtaactgatcgtggtgtcgatggactagatattttgattgagcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggatgcgatcgcttaa

SEQ ID NO: 106 - protein, 1183 aa, Artificial Sequence
  SYNTHETIC FUSION PROTEN
MGSSHHHHHHELPGPRENLYFQGAIAHMNDNVAWFKQAKYGMMIHWGLYSLLAGEYRGESSSAYAEWIQSKFQIPNAEYGNLATAFNPLYFDAKKIVALAKQCGMQYLVVTTKHHDGFAMYHSKVDAYNVYDATPFHRDIIGELAEACQKAGLKFGLYYSQDLDWHDPNGGGYKSNDVETAGTTWDNSWDFPDEDQKNFDLCFDNKILPQIKEIMSNYGDIATAWFDVPMTLSEAQSQTIYDTVRELQPNCLINSRLGNGKYDFVSLGDNEIPKNKEDMNKTDVDYNEITGFKPSPLGLYETAGTINDSWGFSYHDQNWKTPRTLYRYKQHLNDFGINYLLNVGLDPLGRVPMMAEENLLAAKALEDEANREFEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQTIGVNELNGRTGLSKDYPDTPEGNKALAAAIVKAFVTDRGVDGLDILIEHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKDAIA

SEQ ID NO: 107 - DNA, 3552 bp, Artificial Sequence
  SYNTHETIC FUSION PROTEN
atgggcagcagccatcatcaccatcaccatgagctccccgggccgcgggaaaacctgtattttcagggagcgatcgctcatatgaacgacaacgtggcgtggttcaagcaggcgaaatatggcatgatgattcactggggtctgtacagcctgctggcgggcgagtatcgtggtgaaagcagcagcgcgtacgcggagtggatccagagcaagtttcaaattccgaacgcggaatacggcaacctggcgaccgcgttcaacccgctgtattttgatgcgaagaaaatcgttgcgctggcgaaacagtgcggcatgcaatacctggtggttaccaccaagcaccacgacggtttcgcgatgtatcacagcaaagtggacgcgtacaacgtttatgatgcgaccccgtttcaccgtgatatcattggcgagctggcggaagcgtgccagaaggcgggtctgaaattcggtctgtactatagccaagacctggattggcacgacccgaacggtggcggttataagagcaacgatgtggagaccgcgggtaccacctgggacaacagctgggatttcccggacgaagatcagaaaaacttcgacctgtgctttgataacaagatcctgccgcaaatcaaagagattatgagcaactacggtgacattgcgaccgcgtggtttgatgtgccgatgaccctgagcgaggcgcagagccaaaccatctatgacaccgttcgtgaactgcaaccgaactgcctgattaacagccgtctgggcaacggcaagtacgacttcgtgagcctgggcgataacgagatcccgaagaacaaagaagatatgaacaagaccgacgttgattacaacgagattaccggcttcaaaccgagcccgctgggcctgtatgaaaccgcgggtaccatcaacgacagctggggttttagctaccacgatcagaactggaagaccccgcgtaccctgtaccgttataaacaacacctgaacgactttggtattaactacctgctgaacgtgggcctggatccgctgggtcgtgttccgatgatggcggaggaaaacctgctggcggcgaaagcgctggaggacgaagcgaaccgtgaattcgaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcagacaattggtgttaacgaattaaatggacgtacaggtttatctaaagattatcctgatactcctgaggggaacaaagctttagcagcagccattgtcaaggcatttgtaactgatcgtggtgtcgatggactagatatttttattgagcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggatgcgatcgcttaa

SEQ ID NO: 108 - protein, 1183 aa, Artificial Sequence
  SYNTHETIC FUSION PROTEN
MGSSHHHHHHELPGPRENLYFQGAIAHMNDNVAWFKQAKYGMMIHWGLYSLLAGEYRGESSSAYAEWIQSKFQIPNAEYGNLATAFNPLYFDAKKIVALAKQCGMQYLVVTTKHHDGFAMYHSKVDAYNVYDATPFHRDIIGELAEACQKAGLKFGLYYSQDLDWHDPNGGGYKSNDVETAGTTWDNSWDFPDEDQKNFDLCFDNKILPQIKEIMSNYGDIATAWFDVPMTLSEAQSQTIYDTVRELQPNCLINSRLGNGKYDFVSLGDNEIPKNKEDMNKTDVDYNEITGFKPSPLGLYETAGTINDSWGFSYHDQNWKTPRTLYRYKQHLNDFGINYLLNVGLDPLGRVPMMAEENLLAAKALEDEANREFEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQTIGVNELNGRTGLSKDYPDTPEGNKALAAAIVKAFVTDRGVDGLDIFIEHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKDAIA

SEQ ID NO: 109 - DNA, 3108 bp, Artificial Sequence
  SYNTHETIC FUSION PROTEN
atgggcagcagccatcatcatcatcatcacagcagcggcctggtgccgcgcggcagccatatgggtaccctgcagggatccaaagataagtcgtatgatctgattgatgagaaagatttcccagataaggctttgcgagaagctgtgatggcgcaggttggaaccagaaaaggtgatttggaacgtttcaatggcacattacgattggataatccagcgattcaaagtttagaaggtctaaataaatttaaaaaattagctcaattagacttgattggcttatctcgcattacaaagctcgaccgttctgttttacccgctaatatgaagccaggcaaagataccttggaaacagttcttgaaacctataaaaaggataacaaagaagaacctgctactatcccaccagtatctttgaaggtttctggtttaactggtctgaaagaattagatttgtcaggttttgaccgtgaaaccttggctggtcttgatgccgctactctaacgtctttagaaaaagttgatatttctggcaacaaacttgatttggctccaggaacagaaaatcgacaaatttttgatactatgctatcaactatcagcaatcatgttggaagcaatgaacaaacagtgaaatttgacaagcaaaaaccaactgggcattacccagatacctatgggaaaactagtctgcgcttaccagtggcaaatgaaaaagttgatttgcaaagccagcttttgtttgggactgtgacaaatcaaggaaccctaatcaatagcgaagcagactataaggcttaccaaaatcataaaattgctggacgtagctttgttgattcaaactatcattacaataactttaaagtttcttatgagaactataccgttaaagtaactgattccacattgggaaccactactgacaaaacgctagcaactgataaagaagagacctataaggttgacttctttagcccagcagataagacaaaagctgttcatactgctaaagtgattgttggtgacgaaaaaaccatgatggttaatttggcagaaggcgcaacagttattggaggaagtgctgatcctgtaaatgcaagaaaggtatttgatgggcaactgggcagtgagactgataatatctctttaggatgggattctaagcaaagtattatatttaaattgaaagaagatggattaataaagcattggcgtttcttcaatgattcagcccgaaatcctgagacaaccaataaacctattcaggaagcaagtctacaaatttttaatatcaaagattataatctagataatttgttggaaaatcccaataaatttgatgatgaaaaatattggattactgtagatacttacagtgcacaaggagagagagctactgcattcagtaatacattaaataatattactagtaaatattggcgagttgtctttgatactaaaggagatagatatagttcgccagtagtccctgaactccaaattttaggttatccgttacctaacgccgacactatcatgaaaacagtaactactgctaaagagttatctcaacaaaaagataagttttctcaaaagatgcttgatgagttaaaaataaaagagatggctttagaaacttctttgaacagtaagatttttgatgtaactgctattaatgctaatgctggagttttgaaagattgtattgagaaaaggcagctgctaaaaaaaggcggtgcacaggaagcaaaaaaagaaattccgctgaaatatggcgccaccaatgaaggtaaacgtcaggaccctgccatgcagaaatttcgtgataatcgtctgggcgcatttattcattggggcctgtatgcaattccgggtggtgaatggaatggtaaagtgtatggtggtgcagcagaatggctgaaaagttgggcaaaagttccggccgatgaatggctgaagctgatggatcagtggaatccgaccaaatttgatgcaaaaaaatgggccaaaatggccaaagaaatgggcaccaaatatgtgaaaattaccaccaaacatcacgaaggcttttgcctgtggccgagtaaatataccaaatataccgtggccaataccccgtataaacgtgatattctgggcgaactggttaaagcctataatgatgaaggtattgatgttcatttctactttagcgtgatggattggagcaatccggattatcgttatgatattaaaagcaaagaggacagtatcgcctttagtcgctttctggaatttaccgataatcagctgaaagaactggccacccgttatccgaccgttaaagatttttggtttgatggtacctgggatgcaagcgtgaaaaaaaatggttggtggaccgcacatgcagaacagatgctgaaagaattagttccgggtgttgcaattaatagtcgcctgcgtgcagatgataaaggtaaacgtcattttgatagcaatggccgtctgatgggcgattatgaaagtggttatgaacgtcgtctgccggaccctgtgaaagatctgaaagtgacccagtgggattgggaagcatgcatgaccattccggaaaatcagtggggctatcataaagattggagtctgagttatgttaaaaccccgattgaagtgattgatcgtattgtgcatgccgttagcatgggtggtaatatggtggtgaattttggtccgcaggcagatggtgattttcgtccggaagaaaaagcaatggcaaccgcaattggtaaatggatgaatcgctatggtaaagcagtttatgcctgtgattatgccggttttgaaaaacaggattggggttattatacccgcggtaaaaatgatgaagtttatatggttgtgttcaaccagccgtatagcgaacgtctgattgttaaaacccctaaaggtattaccgtggaaaaagcaaccctgctgaccaccggcgaagatattaccgttgtggaaaccacccgtaatgaatataatgttagtgttccgaaaaagaacccgggcgaaccgtatgttattcagctgaaagttcgtgcagccaaaggcaccaaaagtatttatcgtgatgccctgacgtaa

SEQ ID NO: 110 - protein, 1035 aa, Artificial Sequence
  SYNTHETIC FUSION PROTEN
MGSSHHHHHHSSGLVPRGSHMGTLQGSKDKSYDLIDEKDFPDKALREAVMAQVGTRKGDLERFNGTLRLDNPAIQSLEGLNKFKKLAQLDLIGLSRITKLDRSVLPANMKPGKDTLETVLETYKKDNKEEPATIPPVSLKVSGLTGLKELDLSGFDRETLAGLDAATLTSLEKVDISGNKLDLAPGTENRQIFDTMLSTISNHVGSNEQTVKFDKQKPTGHYPDTYGKTSLRLPVANEKVDLQSQLLFGTVTNQGTLINSEADYKAYQNHKIAGRSFVDSNYHYNNFKVSYENYTVKVTDSTLGTTTDKTLATDKEETYKVDFFSPADKTKAVHTAKVIVGDEKTMMVNLAEGATVIGGSADPVNARKVFDGQLGSETDNISLGWDSKQSIIFKLKEDGLIKHWRFFNDSARNPETTNKPIQEASLQIFNIKDYNLDNLLENPNKFDDEKYWITVDTYSAQGERATAFSNTLNNITSKYWRVVFDTKGDRYSSPVVPELQILGYPLPNADTIMKTVTTAKELSQQKDKFSQKMLDELKIKEMALETSLNSKIFDVTAINANAGVLKDCIEKRQLLKKGGAQEAKKEIPLKYGATNEGKRQDPAMQKFRDNRLGAFIHWGLYAIPGGEWNGKVYGGAAEWLKSWAKVPADEWLKLMDQWNPTKFDAKKWAKMAKEMGTKYVKITTKHHEGFCLWPSKYTKYTVANTPYKRDILGELVKAYNDEGIDVHFYFSVMDWSNPDYRYDIKSKEDSIAFSRFLEFTDNQLKELATRYPTVKDFWFDGTWDASVKKNGWWTAHAEQMLKELVPGVAINSRLRADDKGKRHFDSNGRLMGDYESGYERRLPDPVKDLKVTQWDWEACMTIPENQWGYHKDWSLSYVKTPIEVIDRIVHAVSMGGNMVVNFGPQADGDFRPEEKAMATAIGKWMNRYGKAVYACDYAGFEKQDWGYYTRGKNDEVYMVVFNQPYSERLIVKTPKGITVEKATLLTTGEDITVVETTRNEYNVSVPKKNPGEPYVIQLKVRAAKGTKSIYRDALT

SEQ ID NO: 111 - DNA, 2835 bp, Artificial Sequence
  SYNTHETIC FUSION PROTEN
atgggcagcagccatcatcatcatcatcacagcagcggcctggtgccgcgcggcagccatatgggtaccctgcagggatccaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggatggcggtgcacaggaagcaaaaaaagaaattccgctgaaatatggcgccaccaatgaaggtaaacgtcaggaccctgccatgcagaaatttcgtgataatcgtctgggcgcatttattcattggggcctgtatgcaattccgggtggtgaatggaatggtaaagtgtatggtggtgcagcagaatggctgaaaagttgggcaaaagttccggccgatgaatggctgaagctgatggatcagtggaatccgaccaaatttgatgcaaaaaaatgggccaaaatggccaaagaaatgggcaccaaatatgtgaaaattaccaccaaacatcacgaaggcttttgcctgtggccgagtaaatataccaaatataccgtggccaataccccgtataaacgtgatattctgggcgaactggttaaagcctataatgatgaaggtattgatgttcatttctactttagcgtgatggattggagcaatccggattatcgttatgatattaaaagcaaagaggacagtatcgcctttagtcgctttctggaatttaccgataatcagctgaaagaactggccacccgttatccgaccgttaaagatttttggtttgatggtacctgggatgcaagcgtgaaaaaaaatggttggtggaccgcacatgcagaacagatgctgaaagaattagttccgggtgttgcaattaatagtcgcctgcgtgcagatgataaaggtaaacgtcattttgatagcaatggccgtctgatgggcgattatgaaagtggttatgaacgtcgtctgccggaccctgtgaaagatctgaaagtgacccagtgggattgggaagcatgcatgaccattccggaaaatcagtggggctatcataaagattggagtctgagttatgttaaaaccccgattgaagtgattgatcgtattgtgcatgccgttagcatgggtggtaatatggtggtgaattttggtccgcaggcagatggtgattttcgtccggaagaaaaagcaatggcaaccgcaattggtaaatggatgaatcgctatggtaaagcagtttatgcctgtgattatgccggttttgaaaaacaggattggggttattatacccgcggtaaaaatgatgaagtttatatggttgtgttcaaccagccgtatagcgaacgtctgattgttaaaacccctaaaggtattaccgtggaaaaagcaaccctgctgaccaccggcgaagatattaccgttgtggaaaccacccgtaatgaatataatgttagtgttccgaaaaagaacccgggcgaaccgtatgttattcagctgaaagttcgtgcagccaaaggcaccaaaagtatttatcgtgatgccctgacgtaa

SEQ ID NO: 112 - protein, 944 aa, Artificial Sequence
  SYNTHETIC FUSION PROTEN
MGSSHHHHHHSSGLVPRGSHMGTLQGSTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKDGGAQEAKKEIPLKYGATNEGKRQDPAMQKFRDNRLGAFIHWGLYAIPGGEWNGKVYGGAAEWLKSWAKVPADEWLKLMDQWNPTKFDAKKWAKMAKEMGTKYVKITTKHHEGFCLWPSKYTKYTVANTPYKRDILGELVKAYNDEGIDVHFYFSVMDWSNPDYRYDIKSKEDSIAFSRFLEFTDNQLKELATRYPTVKDFWFDGTWDASVKKNGWWTAHAEQMLKELVPGVAINSRLRADDKGKRHFDSNGRLMGDYESGYERRLPDPVKDLKVTQWDWEACMTIPENQWGYHKDWSLSYVKTPIEVIDRIVHAVSMGGNMVVNFGPQADGDFRPEEKAMATAIGKWMNRYGKAVYACDYAGFEKQDWGYYTRGKNDEVYMVVFNQPYSERLIVKTPKGITVEKATLLTTGEDITVVETTRNEYNVSVPKKNPGEPYVIQLKVRAAKGTKSIYRDALT

SEQ ID NO: 113 - DNA, 4383 bp, Artificial Sequence
  SYNTHETIC FUSION PROTEN
atgggcagcagccatcatcatcatcatcacagcagcggcctggtgccgcgcggcagccatatgacccaccatgattcactcaatactgtaaaagcggaggagaagactgttcaggttcagaaaggattaccttctatcgatagcttgcattatctgtcagagaatagcaaaaaagaatttaaagaagaactctcaaaagcggggcaagaatctcaaaaggtcaaagagatattagcaaaagctcagcaggcagataaacaagctcaagaacttgccaaaatgaaaattcctgagaaaataccgatgaaaccgttacatggttctctctacggtggttactttagaacttggcatgacaaaacatcagatccaacagaaaaagacaaagttaactcgatgggagagcttcctaaagaagtagatctagcctttattttccacgattggacaaaagattatagccttttttggaaagaattggccaccaaacatgtgccaaagttaaacaagcaagggacacgtgtcattcgtaccattccatggcgtttcctagctgggggtgataacagtggtattgcagaagataccagtaaatacccaaatacaccagagggaaataaagctttagccaaagctattgttgatgaatatgtttataaatacaaccttgatggcttagatgtggatgttgaacatgatagtattccaaaagttgacaaaaaagaagatacagcaggcgtagaacgctctattcaagtgtttgaagaaattgggaaattaattggaccaaaaggtgttgataaatcgcggttatttattatggatagcacctacatggctgataaaaacccattgattgagcgaggagctccttatattaatttattactggtacaggtctatggttcacaaggagagaaaggtggttgggagcctgtttctaatcgacctgaaaaaacaatggaagaacgatggcaaggttatagcaagtatattcgtcctgaacaatacatgattggtttttctttctatgaggaaaatgctcaagaagggaatctttggtatgatattaattctcgcaaggacgaggacaaagcaaatggaattaacactgacataactggaacgcgtgccgaacggtatgcaaggtggcaacctaagacaggtggggttaagggaggtatcttctcctacgctattgaccgagatggtgtagctcatcaacctaaaaaatatgctaaacagaaagagtttaaggacgcaactgataacatcttccactcagattatagtgtctccaaggcattaaagacagttatgctaaaagataagtcgtatgatctgattgatgagaaagatttcccagataaggctttgcgagaagctgtgatggcgcaggttggaaccagaaaaggtgatttggaacgtttcaatggcacattacgattggataatccagcgattcaaagtttagaaggtctaaataaatttaaaaaattagctcaattagacttgattggcttatctcgcattacaaagctcgaccgttctgttttacccgctaatatgaagccaggcaaagataccttggaaacagttcttgaaacctataaaaaggataacaaagaagaacctgctactatcccaccagtatctttgaaggtttctggtttaactggtctgaaagaattagatttgtcaggttttgaccgtgaaaccttggctggtcttgatgccgctactctaacgtctttagaaaaagttgatatttctggcaacaaacttgatttggctccaggaacagaaaatcgacaaatttttgatactatgctatcaactatcagcaatcatgttggaagcaatgaacaaacagtgaaatttgacaagcaaaaaccaactgggcattacccagatacctatgggaaaactagtctgcgcttaccagtggcaaatgaaaaagttgatttgcaaagccagcttttgtttgggactgtgacaaatcaaggaaccctaatcaatagcgaagcagactataaggcttaccaaaatcataaaattgctggacgtagctttgttgattcaaactatcattacaataactttaaagtttcttatgagaactataccgttaaagtaactgattccacattgggaaccactactgacaaaacgctagcaactgataaagaagagacctataaggttgacttctttagcccagcagataagacaaaagctgttcatactgctaaagtgattgttggtgacgaaaaaaccatgatggttaatttggcagaaggcgcaacagttattggaggaagtgctgatcctgtaaatgcaagaaaggtatttgatgggcaactgggcagtgagactgataatatctctttaggatgggattctaagcaaagtattatatttaaattgaaagaagatggattaataaagcattggcgtttcttcaatgattcagcccgaaatcctgagacaaccaataaacctattcaggaagcaagtctacaaatttttaatatcaaagattataatctagataatttgttggaaaatcccaataaatttgatgatgaaaaatattggattactgtagatacttacagtgcacaaggagagagagctactgcattcagtaatacattaaataatattactagtaaatattggcgagttgtctttgatactaaaggagatagatatagttcgccagtagtccctgaactccaaattttaggttatccgttacctaacgccgacactatcatgaaaacagtaactactgctaaagagttatctcaacaaaaagataagttttctcaaaagatgcttgatgagttaaaaataaaagagatggctttagaaacttctttgaacagtaagatttttgatgtaactgctattaatgctaatgctggagttttgaaagattgtattgagaaaaggcagctgctaaaaaaaggatccggtgctcaggaagcaaaaaaagaaattccgctgaaatatggcgccaccaatgaaggtaaacgtcaggaccctgccatgcagaaatttcgtgataatcgtctgggcgcatttattcattggggcctgtatgcaattccgggtggtgaatggaatggtaaagtgtatggtggtgcagcagaatggctgaaaagttgggcaaaagttccggccgatgaatggctgaagctgatggatcagtggaatccgaccaaatttgatgcaaaaaaatgggccaaaatggccaaagaaatgggcaccaaatatgtgaaaattaccaccaaacatcacgaaggcttttgcctgtggccgagtaaatataccaaatataccgtggccaataccccgtataaacgtgatattctgggcgaactggttaaagcctataatgatgaaggtattgatgttcatttctactttagcgtgatggattggagcaatccggattatcgttatgatattaaaagcaaagaggacagtatcgcctttagtcgctttctggaatttaccgataatcagctgaaagaactggccacccgttatccgaccgttaaagatttttggtttgatggtacctgggatgcaagcgtgaaaaaaaatggttggtggaccgcacatgcagaacagatgctgaaagaattagttccgggtgttgcaattaatagtcgcctgcgtgcagatgataaaggtaaacgtcattttgatagcaatggccgtctgatgggcgattatgaaagtggttatgaacgtcgtctgccggaccctgtgaaagatctgaaagtgacccagtgggattgggaagcatgcatgaccattccggaaaatcagtggggctatcataaagattggagtctgagttatgttaaaaccccgattgaagtgattgatcgtattgtgcatgccgttagcatgggtggtaatatggtggtgaattttggtccgcaggcagatggtgattttcgtccggaagaaaaagcaatggcaaccgcaattggtaaatggatgaatcgctatggtaaagcagtttatgcctgtgattatgccggttttgaaaaacaggattggggttattatacccgcggtaaaaatgatgaagtttatatggttgtgttcaaccagccgtatagcgaacgtctgattgttaaaacccctaaaggtattaccgtggaaaaagcaaccctgctgaccaccggcgaagatattaccgttgtggaaaccacccgtaatgaatataatgttagtgttccgaaaaagaacccgggcgaaccgtatgttattcagctgaaagttcgtgcagccaaaggcaccaaaagtatttatcgtgatgccctgacgggtacctggtctcatccgcagttcgagaaataa

SEQ ID NO: 114 - protein, 1460 aa, Artificial Sequence
  SYNTHETIC FUSION PROTEN
MGSSHHHHHHSSGLVPRGSHMTHHDSLNTVKAEEKTVQVQKGLPSIDSLHYLSENSKKEFKEELSKAGQESQKVKEILAKAQQADKQAQELAKMKIPEKIPMKPLHGSLYGGYFRTWHDKTSDPTEKDKVNSMGELPKEVDLAFIFHDWTKDYSLFWKELATKHVPKLNKQGTRVIRTIPWRFLAGGDNSGIAEDTSKYPNTPEGNKALAKAIVDEYVYKYNLDGLDVDVEHDSIPKVDKKEDTAGVERSIQVFEEIGKLIGPKGVDKSRLFIMDSTYMADKNPLIERGAPYINLLLVQVYGSQGEKGGWEPVSNRPEKTMEERWQGYSKYIRPEQYMIGFSFYEENAQEGNLWYDINSRKDEDKANGINTDITGTRAERYARWQPKTGGVKGGIFSYAIDRDGVAHQPKKYAKQKEFKDATDNIFHSDYSVSKALKTVMLKDKSYDLIDEKDFPDKALREAVMAQVGTRKGDLERFNGTLRLDNPAIQSLEGLNKFKKLAQLDLIGLSRITKLDRSVLPANMKPGKDTLETVLETYKKDNKEEPATIPPVSLKVSGLTGLKELDLSGFDRETLAGLDAATLTSLEKVDISGNKLDLAPGTENRQIFDTMLSTISNHVGSNEQTVKFDKQKPTGHYPDTYGKTSLRLPVANEKVDLQSQLLFGTVTNQGTLINSEADYKAYQNHKIAGRSFVDSNYHYNNFKVSYENYTVKVTDSTLGTTTDKTLATDKEETYKVDFFSPADKTKAVHTAKVIVGDEKTMMVNLAEGATVIGGSADPVNARKVFDGQLGSETDNISLGWDSKQSIIFKLKEDGLIKHWRFFNDSARNPETTNKPIQEASLQIFNIKDYNLDNLLENPNKFDDEKYWITVDTYSAQGERATAFSNTLNNITSKYWRVVFDTKGDRYSSPVVPELQILGYPLPNADTIMKTVTTAKELSQQKDKFSQKMLDELKIKEMALETSLNSKIFDVTAINANAGVLKDCIEKRQLLKKGSGAQEAKKEIPLKYGATNEGKRQDPAMQKFRDNRLGAFIHWGLYAIPGGEWNGKVYGGAAEWLKSWAKVPADEWLKLMDQWNPTKFDAKKWAKMAKEMGTKYVKITTKHHEGFCLWPSKYTKYTVANTPYKRDILGELVKAYNDEGIDVHFYFSVMDWSNPDYRYDIKSKEDSIAFSRFLEFTDNQLKELATRYPTVKDFWFDGTWDASVKKNGWWTAHAEQMLKELVPGVAINSRLRADDKGKRHFDSNGRLMGDYESGYERRLPDPVKDLKVTQWDWEACMTIPENQWGYHKDWSLSYVKTPIEVIDRIVHAVSMGGNMVVNFGPQADGDFRPEEKAMATAIGKWMNRYGKAVYACDYAGFEKQDWGYYTRGKNDEVYMVVFNQPYSERLIVKTPKGITVEKATLLTTGEDITVVETTRNEYNVSVPKKNPGEPYVIQLKVRAAKGTKSIYRDALTGTWSHPQFEK

SEQ ID NO: 115 - DNA, 4383 bp, Artificial Sequence
  SYNTHETIC FUSION PROTEN
atgggcagcagccatcatcatcatcatcacagcagcggcctggtgccgcgcggcagccatatgacccaccatgattcactcaatactgtaaaagcggaggagaagactgttcaggttcagaaaggattaccttctatcgatagcttgcattatctgtcagagaatagcaaaaaagaatttaaagaagaactctcaaaagcggggcaagaatctcaaaaggtcaaagagatattagcaaaagctcagcaggcagataaacaagctcaagaacttgccaaaatgaaaattcctgagaaaataccgatgaaaccgttacatggttctctctacggtggttactttagaacttggcatgacaaaacatcagatccaacagaaaaagacaaagttaactcgatgggagagcttcctaaagaagtagatctagcctttattttccacgattggacaaaagattatagccttttttggaaagaattggccaccaaacatgtgccaaagttaaacaagcaagggacacgtgtcattcgtaccattccatggcgtttcctagctgggggtgataacagtggtattgcagaagataccagtaaatacccaaatacaccagagggaaataaagctttagccaaagctattgttgatgaatatgtttataaatacaaccttgatggcttagatgtgcaggttgaacatgatagtattccaaaagttgacaaaaaagaagatacagcaggcgtagaacgctctattcaagtgtttgaagaaattgggaaattaattggaccaaaaggtgttgataaatcgcggttatttattatggatagcacctacatggctgataaaaacccattgattgagcgaggagctccttatattaatttattactggtacaggtctatggttcacaaggagagaaaggtggttgggagcctgtttctaatcgacctgaaaaaacaatggaagaacgatggcaaggttatagcaagtatattcgtcctgaacaatacatgattggtttttctttctatgaggaaaatgctcaagaagggaatctttggtatgatattaattctcgcaaggacgaggacaaagcaaatggaattaacactgacataactggaacgcgtgccgaacggtatgcaaggtggcaacctaagacaggtggggttaagggaggtatcttctcctacgctattgaccgagatggtgtagctcatcaacctaaaaaatatgctaaacagaaagagtttaaggacgcaactgataacatcttccactcagattatagtgtctccaaggcattaaagacagttatgctaaaagataagtcgtatgatctgattgatgagaaagatttcccagataaggctttgcgagaagctgtgatggcgcaggttggaaccagaaaaggtgatttggaacgtttcaatggcacattacgattggataatccagcgattcaaagtttagaaggtctaaataaatttaaaaaattagctcaattagacttgattggcttatctcgcattacaaagctcgaccgttctgttttacccgctaatatgaagccaggcaaagataccttggaaacagttcttgaaacctataaaaaggataacaaagaagaacctgctactatcccaccagtatctttgaaggtttctggtttaactggtctgaaagaattagatttgtcaggttttgaccgtgaaaccttggctggtcttgatgccgctactctaacgtctttagaaaaagttgatatttctggcaacaaacttgatttggctccaggaacagaaaatcgacaaatttttgatactatgctatcaactatcagcaatcatgttggaagcaatgaacaaacagtgaaatttgacaagcaaaaaccaactgggcattacccagatacctatgggaaaactagtctgcgcttaccagtggcaaatgaaaaagttgatttgcaaagccagcttttgtttgggactgtgacaaatcaaggaaccctaatcaatagcgaagcagactataaggcttaccaaaatcataaaattgctggacgtagctttgttgattcaaactatcattacaataactttaaagtttcttatgagaactataccgttaaagtaactgattccacattgggaaccactactgacaaaacgctagcaactgataaagaagagacctataaggttgacttctttagcccagcagataagacaaaagctgttcatactgctaaagtgattgttggtgacgaaaaaaccatgatggttaatttggcagaaggcgcaacagttattggaggaagtgctgatcctgtaaatgcaagaaaggtatttgatgggcaactgggcagtgagactgataatatctctttaggatgggattctaagcaaagtattatatttaaattgaaagaagatggattaataaagcattggcgtttcttcaatgattcagcccgaaatcctgagacaaccaataaacctattcaggaagcaagtctacaaatttttaatatcaaagattataatctagataatttgttggaaaatcccaataaatttgatgatgaaaaatattggattactgtagatacttacagtgcacaaggagagagagctactgcattcagtaatacattaaataatattactagtaaatattggcgagttgtctttgatactaaaggagatagatatagttcgccagtagtccctgaactccaaattttaggttatccgttacctaacgccgacactatcatgaaaacagtaactactgctaaagagttatctcaacaaaaagataagttttctcaaaagatgcttgatgagttaaaaataaaagagatggctttagaaacttctttgaacagtaagatttttgatgtaactgctattaatgctaatgctggagttttgaaagattgtattgagaaaaggcagctgctaaaaaaaggatccggtgctcaggaagcaaaaaaagaaattccgctgaaatatggcgccaccaatgaaggtaaacgtcaggaccctgccatgcagaaatttcgtgataatcgtctgggcgcatttattcattggggcctgtatgcaattccgggtggtgaatggaatggtaaagtgtatggtggtgcagcagaatggctgaaaagttgggcaaaagttccggccgatgaatggctgaagctgatggatcagtggaatccgaccaaatttgatgcaaaaaaatgggccaaaatggccaaagaaatgggcaccaaatatgtgaaaattaccaccaaacatcacgaaggcttttgcctgtggccgagtaaatataccaaatataccgtggccaataccccgtataaacgtgatattctgggcgaactggttaaagcctataatgatgaaggtattgatgttcatttctactttagcgtgatggattggagcaatccggattatcgttatgatattaaaagcaaagaggacagtatcgcctttagtcgctttctggaatttaccgataatcagctgaaagaactggccacccgttatccgaccgttaaagatttttggtttgatggtacctgggatgcaagcgtgaaaaaaaatggttggtggaccgcacatgcagaacagatgctgaaagaattagttccgggtgttgcaattaatagtcgcctgcgtgcagatgataaaggtaaacgtcattttgatagcaatggccgtctgatgggcgattatgaaagtggttatgaacgtcgtctgccggaccctgtgaaagatctgaaagtgacccagtgggattgggaagcatgcatgaccattccggaaaatcagtggggctatcataaagattggagtctgagttatgttaaaaccccgattgaagtgattgatcgtattgtgcatgccgttagcatgggtggtaatatggtggtgaattttggtccgcaggcagatggtgattttcgtccggaagaaaaagcaatggcaaccgcaattggtaaatggatgaatcgctatggtaaagcagtttatgcctgtgattatgccggttttgaaaaacaggattggggttattatacccgcggtaaaaatgatgaagtttatatggttgtgttcaaccagccgtatagcgaacgtctgattgttaaaacccctaaaggtattaccgtggaaaaagcaaccctgctgaccaccggcgaagatattaccgttgtggaaaccacccgtaatgaatataatgttagtgttccgaaaaagaacccgggcgaaccgtatgttattcagctgaaagttcgtgcagccaaaggcaccaaaagtatttatcgtgatgccctgacgggtacctggtctcatccgcagttcgagaaataa

SEQ ID NO: 116 - protein, 1460 aa, Artificial Sequence
  SYNTHETIC FUSION PROTEN
MGSSHHHHHHSSGLVPRGSHMTHHDSLNTVKAEEKTVQVQKGLPSIDSLHYLSENSKKEFKEELSKAGQESQKVKEILAKAQQADKQAQELAKMKIPEKIPMKPLHGSLYGGYFRTWHDKTSDPTEKDKVNSMGELPKEVDLAFIFHDWTKDYSLFWKELATKHVPKLNKQGTRVIRTIPWRFLAGGDNSGIAEDTSKYPNTPEGNKALAKAIVDEYVYKYNLDGLDVQVEHDSIPKVDKKEDTAGVERSIQVFEEIGKLIGPKGVDKSRLFIMDSTYMADKNPLIERGAPYINLLLVQVYGSQGEKGGWEPVSNRPEKTMEERWQGYSKYIRPEQYMIGFSFYEENAQEGNLWYDINSRKDEDKANGINTDITGTRAERYARWQPKTGGVKGGIFSYAIDRDGVAHQPKKYAKQKEFKDATDNIFHSDYSVSKALKTVMLKDKSYDLIDEKDFPDKALREAVMAQVGTRKGDLERFNGTLRLDNPAIQSLEGLNKFKKLAQLDLIGLSRITKLDRSVLPANMKPGKDTLETVLETYKKDNKEEPATIPPVSLKVSGLTGLKELDLSGFDRETLAGLDAATLTSLEKVDISGNKLDLAPGTENRQIFDTMLSTISNHVGSNEQTVKFDKQKPTGHYPDTYGKTSLRLPVANEKVDLQSQLLFGTVTNQGTLINSEADYKAYQNHKIAGRSFVDSNYHYNNFKVSYENYTVKVTDSTLGTTTDKTLATDKEETYKVDFFSPADKTKAVHTAKVIVGDEKTMMVNLAEGATVIGGSADPVNARKVFDGQLGSETDNISLGWDSKQSIIFKLKEDGLIKHWRFFNDSARNPETTNKPIQEASLQIFNIKDYNLDNLLENPNKFDDEKYWITVDTYSAQGERATAFSNTLNNITSKYWRVVFDTKGDRYSSPVVPELQILGYPLPNADTIMKTVTTAKELSQQKDKFSQKMLDELKIKEMALETSLNSKIFDVTAINANAGVLKDCIEKRQLLKKGSGAQEAKKEIPLKYGATNEGKRQDPAMQKFRDNRLGAFIHWGLYAIPGGEWNGKVYGGAAEWLKSWAKVPADEWLKLMDQWNPTKFDAKKWAKMAKEMGTKYVKITTKHHEGFCLWPSKYTKYTVANTPYKRDILGELVKAYNDEGIDVHFYFSVMDWSNPDYRYDIKSKEDSIAFSRFLEFTDNQLKELATRYPTVKDFWFDGTWDASVKKNGWWTAHAEQMLKELVPGVAINSRLRADDKGKRHFDSNGRLMGDYESGYERRLPDPVKDLKVTQWDWEACMTIPENQWGYHKDWSLSYVKTPIEVIDRIVHAVSMGGNMVVNFGPQADGDFRPEEKAMATAIGKWMNRYGKAVYACDYAGFEKQDWGYYTRGKNDEVYMVVFNQPYSERLIVKTPKGITVEKATLLTTGEDITVVETTRNEYNVSVPKKNPGEPYVIQLKVRAAKGTKSIYRDALTGTWSHPQFEK

SEQ ID NO: 117 - DNA, 3894 bp, Artificial Sequence
  SYNTHETIC FUSION PROTEN
atgggcagcagccatcatcatcatcatcacagcagcggcctggtgccgcgcggcagccatatggaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcagacaattggtgttaacgaattaaatggacgtacaggtttatctaaagattatcctgatactcctgaggggaacaaagctttagcagcagccattgtcaaggcatttgtaactgatcgtggtgtcgatggactagatattgatattgagcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggatggatccggtgctcaggaagcaaaaaaagaaattccgctgaaatatggcgccaccaatgaaggtaaacgtcaggaccctgccatgcagaaatttcgtgataatcgtctgggcgcatttattcattggggcctgtatgcaattccgggtggtgaatggaatggtaaagtgtatggtggtgcagcagaatggctgaaaagttgggcaaaagttccggccgatgaatggctgaagctgatggatcagtggaatccgaccaaatttgatgcaaaaaaatgggccaaaatggccaaagaaatgggcaccaaatatgtgaaaattaccaccaaacatcacgaaggcttttgcctgtggccgagtaaatataccaaatataccgtggccaataccccgtataaacgtgatattctgggcgaactggttaaagcctataatgatgaaggtattgatgttcatttctactttagcgtgatggattggagcaatccggattatcgttatgatattaaaagcaaagaggacagtatcgcctttagtcgctttctggaatttaccgataatcagctgaaagaactggccacccgttatccgaccgttaaagatttttggtttgatggtacctgggatgcaagcgtgaaaaaaaatggttggtggaccgcacatgcagaacagatgctgaaagaattagttccgggtgttgcaattaatagtcgcctgcgtgcagatgataaaggtaaacgtcattttgatagcaatggccgtctgatgggcgattatgaaagtggttatgaacgtcgtctgccggaccctgtgaaagatctgaaagtgacccagtgggattgggaagcatgcatgaccattccggaaaatcagtggggctatcataaagattggagtctgagttatgttaaaaccccgattgaagtgattgatcgtattgtgcatgccgttagcatgggtggtaatatggtggtgaattttggtccgcaggcagatggtgattttcgtccggaagaaaaagcaatggcaaccgcaattggtaaatggatgaatcgctatggtaaagcagtttatgcctgtgattatgccggttttgaaaaacaggattggggttattatacccgcggtaaaaatgatgaagtttatatggttgtgttcaaccagccgtatagcgaacgtctgattgttaaaacccctaaaggtattaccgtggaaaaagcaaccctgctgaccaccggcgaagatattaccgttgtggaaaccacccgtaatgaatataatgttagtgttccgaaaaagaacccgggcgaaccgtatgttattcagctgaaagttcgtgcagccaaaggcaccaaaagtatttatcgtgatgccctgacgagtacctggtctcatccgcagttcgagaaataa

SEQ ID NO: 118 - protein, 1297 aa, Artificial Sequence
  SYNTHETIC FUSION PROTEN
MGSSHHHHHHSSGLVPRGSHMEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQTIGVNELNGRTGLSKDYPDTPEGNKALAAAIVKAFVTDRGVDGLDIDIEHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKDGSGAQEAKKEIPLKYGATNEGKRQDPAMQKFRDNRLGAFIHWGLYAIPGGEWNGKVYGGAAEWLKSWAKVPADEWLKLMDQWNPTKFDAKKWAKMAKEMGTKYVKITTKHHEGFCLWPSKYTKYTVANTPYKRDILGELVKAYNDEGIDVHFYFSVMDWSNPDYRYDIKSKEDSIAFSRFLEFTDNQLKELATRYPTVKDFWFDGTWDASVKKNGWWTAHAEQMLKELVPGVAINSRLRADDKGKRHFDSNGRLMGDYESGYERRLPDPVKDLKVTQWDWEACMTIPENQWGYHKDWSLSYVKTPIEVIDRIVHAVSMGGNMVVNFGPQADGDFRPEEKAMATAIGKWMNRYGKAVYACDYAGFEKQDWGYYTRGKNDEVYMVVFNQPYSERLIVKTPKGITVEKATLLTTGEDITVVETTRNEYNVSVPKKNPGEPYVIQLKVRAAKGTKSIYRDALTSTWSHPQFEK

SEQ ID NO: 119 - DNA, 3894 bp, Artificial Sequence
  SYNTHETIC FUSION PROTEN
atgggcagcagccatcatcatcatcatcacagcagcggcctggtgccgcgcggcagccatatggaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcaggaaattggtgttaacgaattaaatggacgtacaggtttatctaaagattatcctgatactcctgaggggaacaaagctttagcagcagccattgtcaaggcatttgtaactgatcgtggtgtcgatggactagatattgatattgagcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggatggatccggtgctcaggaagcaaaaaaagaaattccgctgaaatatggcgccaccaatgaaggtaaacgtcaggaccctgccatgcagaaatttcgtgataatcgtctgggcgcatttattcattggggcctgtatgcaattccgggtggtgaatggaatggtaaagtgtatggtggtgcagcagaatggctgaaaagttgggcaaaagttccggccgatgaatggctgaagctgatggatcagtggaatccgaccaaatttgatgcaaaaaaatgggccaaaatggccaaagaaatgggcaccaaatatgtgaaaattaccaccaaacatcacgaaggcttttgcctgtggccgagtaaatataccaaatataccgtggccaataccccgtataaacgtgatattctgggcgaactggttaaagcctataatgatgaaggtattgatgttcatttctactttagcgtgatggattggagcaatccggattatcgttatgatattaaaagcaaagaggacagtatcgcctttagtcgctttctggaatttaccgataatcagctgaaagaactggccacccgttatccgaccgttaaagatttttggtttgatggtacctgggatgcaagcgtgaaaaaaaatggttggtggaccgcacatgcagaacagatgctgaaagaattagttccgggtgttgcaattaatagtcgcctgcgtgcagatgataaaggtaaacgtcattttgatagcaatggccgtctgatgggcgattatgaaagtggttatgaacgtcgtctgccggaccctgtgaaagatctgaaagtgacccagtgggattgggaagcatgcatgaccattccggaaaatcagtggggctatcataaagattggagtctgagttatgttaaaaccccgattgaagtgattgatcgtattgtgcatgccgttagcatgggtggtaatatggtggtgaattttggtccgcaggcagatggtgattttcgtccggaagaaaaagcaatggcaaccgcaattggtaaatggatgaatcgctatggtaaagcagtttatgcctgtgattatgccggttttgaaaaacaggattggggttattatacccgcggtaaaaatgatgaagtttatatggttgtgttcaaccagccgtatagcgaacgtctgattgttaaaacccctaaaggtattaccgtggaaaaagcaaccctgctgaccaccggcgaagatattaccgttgtggaaaccacccgtaatgaatataatgttagtgttccgaaaaagaacccgggcgaaccgtatgttattcagctgaaagttcgtgcagccaaaggcaccaaaagtatttatcgtgatgccctgacgagtacctggtctcatccgcagttcgagaaataa

SEQ ID NO: 120 - protein, 1297 aa, Artificial Sequence
  SYNTHETIC FUSION PROTEN
MGSSHHHHHHSSGLVPRGSHMEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQEIGVNELNGRTGLSKDYPDTPEGNKALAAAIVKAFVTDRGVDGLDIDIEHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKDGSGAQEAKKEIPLKYGATNEGKRQDPAMQKFRDNRLGAFIHWGLYAIPGGEWNGKVYGGAAEWLKSWAKVPADEWLKLMDQWNPTKFDAKKWAKMAKEMGTKYVKITTKHHEGFCLWPSKYTKYTVANTPYKRDILGELVKAYNDEGIDVHFYFSVMDWSNPDYRYDIKSKEDSIAFSRFLEFTDNQLKELATRYPTVKDFWFDGTWDASVKKNGWWTAHAEQMLKELVPGVAINSRLRADDKGKRHFDSNGRLMGDYESGYERRLPDPVKDLKVTQWDWEACMTIPENQWGYHKDWSLSYVKTPIEVIDRIVHAVSMGGNMVVNFGPQADGDFRPEEKAMATAIGKWMNRYGKAVYACDYAGFEKQDWGYYTRGKNDEVYMVVFNQPYSERLIVKTPKGITVEKATLLTTGEDITVVETTRNEYNVSVPKKNPGEPYVIQLKVRAAKGTKSIYRDALTSTWSHPQFEK

SEQ ID NO: 121 - DNA, 3894 bp, Artificial Sequence
  SYNTHETIC FUSION PROTEN
atgggcagcagccatcatcatcatcatcacagcagcggcctggtgccgcgcggcagccatatggaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcagatgattggtgttaacgaattaaatggacgtacaggtttatctaaagattatcctgatactcctgaggggaacaaagctttagcagcagccattgtcaaggcatttgtaactgatcgtggtgtcgatggactagatattgatattgagcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggatggatccggtgctcaggaagcaaaaaaagaaattccgctgaaatatggcgccaccaatgaaggtaaacgtcaggaccctgccatgcagaaatttcgtgataatcgtctgggcgcatttattcattggggcctgtatgcaattccgggtggtgaatggaatggtaaagtgtatggtggtgcagcagaatggctgaaaagttgggcaaaagttccggccgatgaatggctgaagctgatggatcagtggaatccgaccaaatttgatgcaaaaaaatgggccaaaatggccaaagaaatgggcaccaaatatgtgaaaattaccaccaaacatcacgaaggcttttgcctgtggccgagtaaatataccaaatataccgtggccaataccccgtataaacgtgatattctgggcgaactggttaaagcctataatgatgaaggtattgatgttcatttctactttagcgtgatggattggagcaatccggattatcgttatgatattaaaagcaaagaggacagtatcgcctttagtcgctttctggaatttaccgataatcagctgaaagaactggccacccgttatccgaccgttaaagatttttggtttgatggtacctgggatgcaagcgtgaaaaaaaatggttggtggaccgcacatgcagaacagatgctgaaagaattagttccgggtgttgcaattaatagtcgcctgcgtgcagatgataaaggtaaacgtcattttgatagcaatggccgtctgatgggcgattatgaaagtggttatgaacgtcgtctgccggaccctgtgaaagatctgaaagtgacccagtgggattgggaagcatgcatgaccattccggaaaatcagtggggctatcataaagattggagtctgagttatgttaaaaccccgattgaagtgattgatcgtattgtgcatgccgttagcatgggtggtaatatggtggtgaattttggtccgcaggcagatggtgattttcgtccggaagaaaaagcaatggcaaccgcaattggtaaatggatgaatcgctatggtaaagcagtttatgcctgtgattatgccggttttgaaaaacaggattggggttattatacccgcggtaaaaatgatgaagtttatatggttgtgttcaaccagccgtatagcgaacgtctgattgttaaaacccctaaaggtattaccgtggaaaaagcaaccctgctgaccaccggcgaagatattaccgttgtggaaaccacccgtaatgaatataatgttagtgttccgaaaaagaacccgggcgaaccgtatgttattcagctgaaagttcgtgcagccaaaggcaccaaaagtatttatcgtgatgccctgacgagtacctggtctcatccgcagttcgagaaataa

SEQ ID NO: 122 - protein, 1297 aa, Artificial Sequence
  SYNTHETIC FUSION PROTEN
MGSSHHHHHHSSGLVPRGSHMEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQMIGVNELNGRTGLSKDYPDTPEGNKALAAAIVKAFVTDRGVDGLDIDIEHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKDGSGAQEAKKEIPLKYGATNEGKRQDPAMQKFRDNRLGAFIHWGLYAIPGGEWNGKVYGGAAEWLKSWAKVPADEWLKLMDQWNPTKFDAKKWAKMAKEMGTKYVKITTKHHEGFCLWPSKYTKYTVANTPYKRDILGELVKAYNDEGIDVHFYFSVMDWSNPDYRYDIKSKEDSIAFSRFLEFTDNQLKELATRYPTVKDFWFDGTWDASVKKNGWWTAHAEQMLKELVPGVAINSRLRADDKGKRHFDSNGRLMGDYESGYERRLPDPVKDLKVTQWDWEACMTIPENQWGYHKDWSLSYVKTPIEVIDRIVHAVSMGGNMVVNFGPQADGDFRPEEKAMATAIGKWMNRYGKAVYACDYAGFEKQDWGYYTRGKNDEVYMVVFNQPYSERLIVKTPKGITVEKATLLTTGEDITVVETTRNEYNVSVPKKNPGEPYVIQLKVRAAKGTKSIYRDALTSTWSHPQFEK

SEQ ID NO: 123 - DNA, 3894 bp, Artificial Sequence
  SYNTHETIC FUSION PROTEN
atgggcagcagccatcatcatcatcatcacagcagcggcctggtgccgcgcggcagccatatggaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcagacaattggtgttaacgaattaaatggacgtacaggtttatctaaagattatcctgatactcctgaggggaacaaagctttagcagcagccattgtcaaggcatttgtaactgatcgtggtgtcgatggactagatattatgattgagcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggatggatccggtgctcaggaagcaaaaaaagaaattccgctgaaatatggcgccaccaatgaaggtaaacgtcaggaccctgccatgcagaaatttcgtgataatcgtctgggcgcatttattcattggggcctgtatgcaattccgggtggtgaatggaatggtaaagtgtatggtggtgcagcagaatggctgaaaagttgggcaaaagttccggccgatgaatggctgaagctgatggatcagtggaatccgaccaaatttgatgcaaaaaaatgggccaaaatggccaaagaaatgggcaccaaatatgtgaaaattaccaccaaacatcacgaaggcttttgcctgtggccgagtaaatataccaaatataccgtggccaataccccgtataaacgtgatattctgggcgaactggttaaagcctataatgatgaaggtattgatgttcatttctactttagcgtgatggattggagcaatccggattatcgttatgatattaaaagcaaagaggacagtatcgcctttagtcgctttctggaatttaccgataatcagctgaaagaactggccacccgttatccgaccgttaaagatttttggtttgatggtacctgggatgcaagcgtgaaaaaaaatggttggtggaccgcacatgcagaacagatgctgaaagaattagttccgggtgttgcaattaatagtcgcctgcgtgcagatgataaaggtaaacgtcattttgatagcaatggccgtctgatgggcgattatgaaagtggttatgaacgtcgtctgccggaccctgtgaaagatctgaaagtgacccagtgggattgggaagcatgcatgaccattccggaaaatcagtggggctatcataaagattggagtctgagttatgttaaaaccccgattgaagtgattgatcgtattgtgcatgccgttagcatgggtggtaatatggtggtgaattttggtccgcaggcagatggtgattttcgtccggaagaaaaagcaatggcaaccgcaattggtaaatggatgaatcgctatggtaaagcagtttatgcctgtgattatgccggttttgaaaaacaggattggggttattatacccgcggtaaaaatgatgaagtttatatggttgtgttcaaccagccgtatagcgaacgtctgattgttaaaacccctaaaggtattaccgtggaaaaagcaaccctgctgaccaccggcgaagatattaccgttgtggaaaccacccgtaatgaatataatgttagtgttccgaaaaagaacccgggcgaaccgtatgttattcagctgaaagttcgtgcagccaaaggcaccaaaagtatttatcgtgatgccctgacgagtacctggtctcatccgcagttcgagaaataa

SEQ ID NO: 124 - protein, 1297 aa, Artificial Sequence
  SYNTHETIC FUSION PROTEN
MGSSHHHHHHSSGLVPRGSHMEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQTIGVNELNGRTGLSKDYPDTPEGNKALAAAIVKAFVTDRGVDGLDIMIEHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKDGSGAQEAKKEIPLKYGATNEGKRQDPAMQKFRDNRLGAFIHWGLYAIPGGEWNGKVYGGAAEWLKSWAKVPADEWLKLMDQWNPTKFDAKKWAKMAKEMGTKYVKITTKHHEGFCLWPSKYTKYTVANTPYKRDILGELVKAYNDEGIDVHFYFSVMDWSNPDYRYDIKSKEDSIAFSRFLEFTDNQLKELATRYPTVKDFWFDGTWDASVKKNGWWTAHAEQMLKELVPGVAINSRLRADDKGKRHFDSNGRLMGDYESGYERRLPDPVKDLKVTQWDWEACMTIPENQWGYHKDWSLSYVKTPIEVIDRIVHAVSMGGNMVVNFGPQADGDFRPEEKAMATAIGKWMNRYGKAVYACDYAGFEKQDWGYYTRGKNDEVYMVVFNQPYSERLIVKTPKGITVEKATLLTTGEDITVVETTRNEYNVSVPKKNPGEPYVIQLKVRAAKGTKSIYRDALTSTWSHPQFEK

SEQ ID NO: 125 - DNA, 3087 bp, Artificial Sequence
  SYNTHETIC FUSION PROTEN
atgggcagcagccatcatcatcatcatcacagcagcggcctggtgccgcgcggcagccatatgcaggaagcaaaaaaagaaattccgctgaaatatggcgccaccaatgaaggtaaacgtcaggaccctgccatgcagaaatttcgtgataatcgtctgggcgcatttattcattggggcctgtatgcaattccgggtggtgaatggaatggtaaagtgtatggtggtgcagcagaatggctgaaaagttgggcaaaagttccggccgatgaatggctgaagctgatggatcagtggaatccgaccaaatttgatgcaaaaaaatgggccaaaatggccaaagaaatgggcaccaaatatgtgaaaattaccaccaaacatcacgaaggcttttgcctgtggccgagtaaatataccaaatataccgtggccaataccccgtataaacgtgatattctgggcgaactggttaaagcctataatgatgaaggtattgatgttcatttctactttagcgtgatggattggagcaatccggattatcgttatgatattaaaagcaaagaggacagtatcgcctttagtcgctttctggaatttaccgataatcagctgaaagaactggccacccgttatccgaccgttaaagatttttggtttgatggtacctgggatgcaagcgtgaaaaaaaatggttggtggaccgcacatgcagaacagatgctgaaagaattagttccgggtgttgcaattaatagtcgcctgcgtgcagatgataaaggtaaacgtcattttgatagcaatggccgtctgatgggcgattatgaaagtggttatgaacgtcgtctgccggaccctgtgaaagatctgaaagtgacccagtgggattgggaagcatgcatgaccattccggaaaatcagtggggctatcataaagattggagtctgagttatgttaaaaccccgattgaagtgattgatcgtattgtgcatgccgttagcatgggtggtaatatggtggtgaattttggtccgcaggcagatggtgattttcgtccggaagaaaaagcaatggcaaccgcaattggtaaatggatgaatcgctatggtaaagcagtttatgcctgtgattatgccggttttgaaaaacaggattggggttattatacccgcggtaaaaatgatgaagtttatatggttgtgttcaaccagccgtatagcgaacgtctgattgttaaaacccctaaaggtattaccgtggaaaaagcaaccctgctgaccaccggcgaagatattaccgttgtggaaaccacccgtaatgaatataatgttagtgttccgaaaaagaacccgggcgaaccgtatgttattcagctgaaagttcgtgcagccaaaggcaccaaaagtatttatcgtgatgccctgacgggatccaaagataagtcgtatgatctgattgatgagaaagatttcccagataaggctttgcgagaagctgtgatggcgcaggttggaaccagaaaaggtgatttggaacgtttcaatggcacattacgattggataatccagcgattcaaagtttagaaggtctaaataaatttaaaaaattagctcaattagacttgattggcttatctcgcattacaaagctcgaccgttctgttttacccgctaatatgaagccaggcaaagataccttggaaacagttcttgaaacctataaaaaggataacaaagaagaacctgctactatcccaccagtatctttgaaggtttctggtttaactggtctgaaagaattagatttgtcaggttttgaccgtgaaaccttggctggtcttgatgccgctactctaacgtctttagaaaaagttgatatttctggcaacaaacttgatttggctccaggaacagaaaatcgacaaatttttgatactatgctatcaactatcagcaatcatgttggaagcaatgaacaaacagtgaaatttgacaagcaaaaaccaactgggcattacccagatacctatgggaaaactagtctgcgcttaccagtggcaaatgaaaaagttgatttgcaaagccagcttttgtttgggactgtgacaaatcaaggaaccctaatcaatagcgaagcagactataaggcttaccaaaatcataaaattgctggacgtagctttgttgattcaaactatcattacaataactttaaagtttcttatgagaactataccgttaaagtaactgattccacattgggaaccactactgacaaaacgctagcaactgataaagaagagacctataaggttgacttctttagcccagcagataagacaaaagctgttcatactgctaaagtgattgttggtgacgaaaaaaccatgatggttaatttggcagaaggcgcaacagttattggaggaagtgctgatcctgtaaatgcaagaaaggtatttgatgggcaactgggcagtgagactgataatatctctttaggatgggattctaagcaaagtattatatttaaattgaaagaagatggattaataaagcattggcgtttcttcaatgattcagcccgaaatcctgagacaaccaataaacctattcaggaagcaagtctacaaatttttaatatcaaagattataatctagataatttgttggaaaatcccaataaatttgatgatgaaaaatattggattactgtagatacttacagtgcacaaggagagagagctactgcattcagtaatacattaaataatattactagtaaatattggcgagttgtctttgatactaaaggagatagatatagttcgccagtagtccctgaactccaaattttaggttatccgttacctaacgccgacactatcatgaaaacagtaactactgctaaagagttatctcaacaaaaagataagttttctcaaaagatgcttgatgagttaaaaataaaagagatggctttagaaacttctttgaacagtaagatttttgatgtaactgctattaatgctaatgctggagttttgaaagattgtattgagaaaaggcagctgctaaaaaaataa

SEQ ID NO: 126 - protein, 1028 aa, Artificial Sequence
  SYNTHETIC FUSION PROTEN
MGSSHHHHHHSSGLVPRGSHMQEAKKEIPLKYGATNEGKRQDPAMQKFRDNRLGAFIHWGLYAIPGGEWNGKVYGGAAEWLKSWAKVPADEWLKLMDQWNPTKFDAKKWAKMAKEMGTKYVKITTKHHEGFCLWPSKYTKYTVANTPYKRDILGELVKAYNDEGIDVHFYFSVMDWSNPDYRYDIKSKEDSIAFSRFLEFTDNQLKELATRYPTVKDFWFDGTWDASVKKNGWWTAHAEQMLKELVPGVAINSRLRADDKGKRHFDSNGRLMGDYESGYERRLPDPVKDLKVTQWDWEACMTIPENQWGYHKDWSLSYVKTPIEVIDRIVHAVSMGGNMVVNFGPQADGDFRPEEKAMATAIGKWMNRYGKAVYACDYAGFEKQDWGYYTRGKNDEVYMVVFNQPYSERLIVKTPKGITVEKATLLTTGEDITVVETTRNEYNVSVPKKNPGEPYVIQLKVRAAKGTKSIYRDALTGSKDKSYDLIDEKDFPDKALREAVMAQVGTRKGDLERFNGTLRLDNPAIQSLEGLNKFKKLAQLDLIGLSRITKLDRSVLPANMKPGKDTLETVLETYKKDNKEEPATIPPVSLKVSGLTGLKELDLSGFDRETLAGLDAATLTSLEKVDISGNKLDLAPGTENRQIFDTMLSTISNHVGSNEQTVKFDKQKPTGHYPDTYGKTSLRLPVANEKVDLQSQLLFGTVTNQGTLINSEADYKAYQNHKIAGRSFVDSNYHYNNFKVSYENYTVKVTDSTLGTTTDKTLATDKEETYKVDFFSPADKTKAVHTAKVIVGDEKTMMVNLAEGATVIGGSADPVNARKVFDGQLGSETDNISLGWDSKQSIIFKLKEDGLIKHWRFFNDSARNPETTNKPIQEASLQIFNIKDYNLDNLLENPNKFDDEKYWITVDTYSAQGERATAFSNTLNNITSKYWRVVFDTKGDRYSSPVVPELQILGYPLPNADTIMKTVTTAKELSQQKDKFSQKMLDELKIKEMALETSLNSKIFDVTAINANAGVLKDCIEKRQLLKK

SEQ ID NO: 127 - DNA, 2814 bp, Artificial Sequence
  SYNTHETIC FUSION PROTEN
atgggcagcagccatcatcatcatcatcacagcagcggcctggtgccgcgcggcagccatatgcaggaagcaaaaaaagaaattccgctgaaatatggcgccaccaatgaaggtaaacgtcaggaccctgccatgcagaaatttcgtgataatcgtctgggcgcatttattcattggggcctgtatgcaattccgggtggtgaatggaatggtaaagtgtatggtggtgcagcagaatggctgaaaagttgggcaaaagttccggccgatgaatggctgaagctgatggatcagtggaatccgaccaaatttgatgcaaaaaaatgggccaaaatggccaaagaaatgggcaccaaatatgtgaaaattaccaccaaacatcacgaaggcttttgcctgtggccgagtaaatataccaaatataccgtggccaataccccgtataaacgtgatattctgggcgaactggttaaagcctataatgatgaaggtattgatgttcatttctactttagcgtgatggattggagcaatccggattatcgttatgatattaaaagcaaagaggacagtatcgcctttagtcgctttctggaatttaccgataatcagctgaaagaactggccacccgttatccgaccgttaaagatttttggtttgatggtacctgggatgcaagcgtgaaaaaaaatggttggtggaccgcacatgcagaacagatgctgaaagaattagttccgggtgttgcaattaatagtcgcctgcgtgcagatgataaaggtaaacgtcattttgatagcaatggccgtctgatgggcgattatgaaagtggttatgaacgtcgtctgccggaccctgtgaaagatctgaaagtgacccagtgggattgggaagcatgcatgaccattccggaaaatcagtggggctatcataaagattggagtctgagttatgttaaaaccccgattgaagtgattgatcgtattgtgcatgccgttagcatgggtggtaatatggtggtgaattttggtccgcaggcagatggtgattttcgtccggaagaaaaagcaatggcaaccgcaattggtaaatggatgaatcgctatggtaaagcagtttatgcctgtgattatgccggttttgaaaaacaggattggggttattatacccgcggtaaaaatgatgaagtttatatggttgtgttcaaccagccgtatagcgaacgtctgattgttaaaacccctaaaggtattaccgtggaaaaagcaaccctgctgaccaccggcgaagatattaccgttgtggaaaccacccgtaatgaatataatgttagtgttccgaaaaagaacccgggcgaaccgtatgttattcagctgaaagttcgtgcagccaaaggcaccaaaagtatttatcgtgatgccctgacgggatccaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggattaa

SEQ ID NO: 128 - protein, 937 aa, Artificial Sequence
  SYNTHETIC FUSION PROTEN
MGSSHHHHHHSSGLVPRGSHMQEAKKEIPLKYGATNEGKRQDPAMQKFRDNRLGAFIHWGLYAIPGGEWNGKVYGGAAEWLKSWAKVPADEWLKLMDQWNPTKFDAKKWAKMAKEMGTKYVKITTKHHEGFCLWPSKYTKYTVANTPYKRDILGELVKAYNDEGIDVHFYFSVMDWSNPDYRYDIKSKEDSIAFSRFLEFTDNQLKELATRYPTVKDFWFDGTWDASVKKNGWWTAHAEQMLKELVPGVAINSRLRADDKGKRHFDSNGRLMGDYESGYERRLPDPVKDLKVTQWDWEACMTIPENQWGYHKDWSLSYVKTPIEVIDRIVHAVSMGGNMVVNFGPQADGDFRPEEKAMATAIGKWMNRYGKAVYACDYAGFEKQDWGYYTRGKNDEVYMVVFNQPYSERLIVKTPKGITVEKATLLTTGEDITVVETTRNEYNVSVPKKNPGEPYVIQLKVRAAKGTKSIYRDALTGSTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKD

SEQ ID NO: 129 - DNA, 4347 bp, Artificial Sequence
  SYNTHETIC FUSION PROTEN
atgggcagcagccatcatcatcatcatcacagcagcggcctggtgccgcgcggcagccatatgcaggaagcaaaaaaagaaattccgctgaaatatggcgccaccaatgaaggtaaacgtcaggaccctgccatgcagaaatttcgtgataatcgtctgggcgcatttattcattggggcctgtatgcaattccgggtggtgaatggaatggtaaagtgtatggtggtgcagcagaatggctgaaaagttgggcaaaagttccggccgatgaatggctgaagctgatggatcagtggaatccgaccaaatttgatgcaaaaaaatgggccaaaatggccaaagaaatgggcaccaaatatgtgaaaattaccaccaaacatcacgaaggcttttgcctgtggccgagtaaatataccaaatataccgtggccaataccccgtataaacgtgatattctgggcgaactggttaaagcctataatgatgaaggtattgatgttcatttctactttagcgtgatggattggagcaatccggattatcgttatgatattaaaagcaaagaggacagtatcgcctttagtcgctttctggaatttaccgataatcagctgaaagaactggccacccgttatccgaccgttaaagatttttggtttgatggtacctgggatgcaagcgtgaaaaaaaatggttggtggaccgcacatgcagaacagatgctgaaagaattagttccgggtgttgcaattaatagtcgcctgcgtgcagatgataaaggtaaacgtcattttgatagcaatggccgtctgatgggcgattatgaaagtggttatgaacgtcgtctgccggaccctgtgaaagatctgaaagtgacccagtgggattgggaagcatgcatgaccattccggaaaatcagtggggctatcataaagattggagtctgagttatgttaaaaccccgattgaagtgattgatcgtattgtgcatgccgttagcatgggtggtaatatggtggtgaattttggtccgcaggcagatggtgattttcgtccggaagaaaaagcaatggcaaccgcaattggtaaatggatgaatcgctatggtaaagcagtttatgcctgtgattatgccggttttgaaaaacaggattggggttattatacccgcggtaaaaatgatgaagtttatatggttgtgttcaaccagccgtatagcgaacgtctgattgttaaaacccctaaaggtattaccgtggaaaaagcaaccctgctgaccaccggcgaagatattaccgttgtggaaaccacccgtaatgaatataatgttagtgttccgaaaaagaacccgggcgaaccgtatgttattcagctgaaagttcgtgcagccaaaggcaccaaaagtatttatcgtgatgccctgacgggatccacccaccatgattcactcaatactgtaaaagcggaggagaagactgttcaggttcagaaaggattaccttctatcgatagcttgcattatctgtcagagaatagcaaaaaagaatttaaagaagaactctcaaaagcggggcaagaatctcaaaaggtcaaagagatattagcaaaagctcagcaggcagataaacaagctcaagaacttgccaaaatgaaaattcctgagaaaataccgatgaaaccgttacatggttctctctacggtggttactttagaacttggcatgacaaaacatcagatccaacagaaaaagacaaagttaactcgatgggagagcttcctaaagaagtagatctagcctttattttccacgattggacaaaagattatagccttttttggaaagaattggccaccaaacatgtgccaaagttaaacaagcaagggacacgtgtcattcgtaccattccatggcgtttcctagctgggggtgataacagtggtattgcagaagataccagtaaatacccaaatacaccagagggaaataaagctttagccaaagctattgttgatgaatatgtttataaatacaaccttgatggcttagatgtggatgttgaacatgatagtattccaaaagttgacaaaaaagaagatacagcaggcgtagaacgctctattcaagtgtttgaagaaattgggaaattaattggaccaaaaggtgttgataaatcgcggttatttattatggatagcacctacatggctgataaaaacccattgattgagcgaggagctccttatattaatttattactggtacaggtctatggttcacaaggagagaaaggtggttgggagcctgtttctaatcgacctgaaaaaacaatggaagaacgatggcaaggttatagcaagtatattcgtcctgaacaatacatgattggtttttctttctatgaggaaaatgctcaagaagggaatctttggtatgatattaattctcgcaaggacgaggacaaagcaaatggaattaacactgacataactggaacgcgtgccgaacggtatgcaaggtggcaacctaagacaggtggggttaagggaggtatcttctcctacgctattgaccgagatggtgtagctcatcaacctaaaaaatatgctaaacagaaagagtttaaggacgcaactgataacatcttccactcagattatagtgtctccaaggcattaaagacagttatgctaaaagataagtcgtatgatctgattgatgagaaagatttcccagataaggctttgcgagaagctgtgatggcgcaggttggaaccagaaaaggtgatttggaacgtttcaatggcacattacgattggataatccagcgattcaaagtttagaaggtctaaataaatttaaaaaattagctcaattagacttgattggcttatctcgcattacaaagctcgaccgttctgttttacccgctaatatgaagccaggcaaagataccttggaaacagttcttgaaacctataaaaaggataacaaagaagaacctgctactatcccaccagtatctttgaaggtttctggtttaactggtctgaaagaattagatttgtcaggttttgaccgtgaaaccttggctggtcttgatgccgctactctaacgtctttagaaaaagttgatatttctggcaacaaacttgatttggctccaggaacagaaaatcgacaaatttttgatactatgctatcaactatcagcaatcatgttggaagcaatgaacaaacagtgaaatttgacaagcaaaaaccaactgggcattacccagatacctatgggaaaactagtctgcgcttaccagtggcaaatgaaaaagttgatttgcaaagccagcttttgtttgggactgtgacaaatcaaggaaccctaatcaatagcgaagcagactataaggcttaccaaaatcataaaattgctggacgtagctttgttgattcaaactatcattacaataactttaaagtttcttatgagaactataccgttaaagtaactgattccacattgggaaccactactgacaaaacgctagcaactgataaagaagagacctataaggttgacttctttagcccagcagataagacaaaagctgttcatactgctaaagtgattgttggtgacgaaaaaaccatgatggttaatttggcagaaggcgcaacagttattggaggaagtgctgatcctgtaaatgcaagaaaggtatttgatgggcaactgggcagtgagactgataatatctctttaggatgggattctaagcaaagtattatatttaaattgaaagaagatggattaataaagcattggcgtttcttcaatgattcagcccgaaatcctgagacaaccaataaacctattcaggaagcaagtctacaaatttttaatatcaaagattataatctagataatttgttggaaaatcccaataaatttgatgatgaaaaatattggattactgtagatacttacagtgcacaaggagagagagctactgcattcagtaatacattaaataatattactagtaaatattggcgagttgtctttgatactaaaggagatagatatagttcgccagtagtccctgaactccaaattttaggttatccgttacctaacgccgacactatcatgaaaacagtaactactgctaaagagttatctcaacaaaaagataagttttctcaaaagatgcttgatgagttaaaaataaaagagatggctttagaaacttctttgaacagtaagatttttgatgtaactgctattaatgctaatgctggagttttgaaagattgtattgagaaaaggcagctgctaaaaaaataa

SEQ ID NO: 130 - protein, 1448 aa, Artificial Sequence
  SYNTHETIC FUSION PROTEN
MGSSHHHHHHSSGLVPRGSHMQEAKKEIPLKYGATNEGKRQDPAMQKFRDNRLGAFIHWGLYAIPGGEWNGKVYGGAAEWLKSWAKVPADEWLKLMDQWNPTKFDAKKWAKMAKEMGTKYVKITTKHHEGFCLWPSKYTKYTVANTPYKRDILGELVKAYNDEGIDVHFYFSVMDWSNPDYRYDIKSKEDSIAFSRFLEFTDNQLKELATRYPTVKDFWFDGTWDASVKKNGWWTAHAEQMLKELVPGVAINSRLRADDKGKRHFDSNGRLMGDYESGYERRLPDPVKDLKVTQWDWEACMTIPENQWGYHKDWSLSYVKTPIEVIDRIVHAVSMGGNMVVNFGPQADGDFRPEEKAMATAIGKWMNRYGKAVYACDYAGFEKQDWGYYTRGKNDEVYMVVFNQPYSERLIVKTPKGITVEKATLLTTGEDITVVETTRNEYNVSVPKKNPGEPYVIQLKVRAAKGTKSIYRDALTGSTHHDSLNTVKAEEKTVQVQKGLPSIDSLHYLSENSKKEFKEELSKAGQESQKVKEILAKAQQADKQAQELAKMKIPEKIPMKPLHGSLYGGYFRTWHDKTSDPTEKDKVNSMGELPKEVDLAFIFHDWTKDYSLFWKELATKHVPKLNKQGTRVIRTIPWRFLAGGDNSGIAEDTSKYPNTPEGNKALAKAIVDEYVYKYNLDGLDVDVEHDSIPKVDKKEDTAGVERSIQVFEEIGKLIGPKGVDKSRLFIMDSTYMADKNPLIERGAPYINLLLVQVYGSQGEKGGWEPVSNRPEKTMEERWQGYSKYIRPEQYMIGFSFYEENAQEGNLWYDINSRKDEDKANGINTDITGTRAERYARWQPKTGGVKGGIFSYAIDRDGVAHQPKKYAKQKEFKDATDNIFHSDYSVSKALKTVMLKDKSYDLIDEKDFPDKALREAVMAQVGTRKGDLERFNGTLRLDNPAIQSLEGLNKFKKLAQLDLIGLSRITKLDRSVLPANMKPGKDTLETVLETYKKDNKEEPATIPPVSLKVSGLTGLKELDLSGFDRETLAGLDAATLTSLEKVDISGNKLDLAPGTENRQIFDTMLSTISNHVGSNEQTVKFDKQKPTGHYPDTYGKTSLRLPVANEKVDLQSQLLFGTVTNQGTLINSEADYKAYQNHKIAGRSFVDSNYHYNNFKVSYENYTVKVTDSTLGTTTDKTLATDKEETYKVDFFSPADKTKAVHTAKVIVGDEKTMMVNLAEGATVIGGSADPVNARKVFDGQLGSETDNISLGWDSKQSIIFKLKEDGLIKHWRFFNDSARNPETTNKPIQEASLQIFNIKDYNLDNLLENPNKFDDEKYWITVDTYSAQGERATAFSNTLNNITSKYWRVVFDTKGDRYSSPVVPELQILGYPLPNADTIMKTVTTAKELSQQKDKFSQKMLDELKIKEMALETSLNSKIFDVTAINANAGVLKDCIEKRQLLKK

SEQ ID NO: 131 - DNA, 4347 bp, Artificial Sequence
  SYNTHETIC FUSION PROTEN
atgggcagcagccatcatcatcatcatcacagcagcggcctggtgccgcgcggcagccatatgcaggaagcaaaaaaagaaattccgctgaaatatggcgccaccaatgaaggtaaacgtcaggaccctgccatgcagaaatttcgtgataatcgtctgggcgcatttattcattggggcctgtatgcaattccgggtggtgaatggaatggtaaagtgtatggtggtgcagcagaatggctgaaaagttgggcaaaagttccggccgatgaatggctgaagctgatggatcagtggaatccgaccaaatttgatgcaaaaaaatgggccaaaatggccaaagaaatgggcaccaaatatgtgaaaattaccaccaaacatcacgaaggcttttgcctgtggccgagtaaatataccaaatataccgtggccaataccccgtataaacgtgatattctgggcgaactggttaaagcctataatgatgaaggtattgatgttcatttctactttagcgtgatggattggagcaatccggattatcgttatgatattaaaagcaaagaggacagtatcgcctttagtcgctttctggaatttaccgataatcagctgaaagaactggccacccgttatccgaccgttaaagatttttggtttgatggtacctgggatgcaagcgtgaaaaaaaatggttggtggaccgcacatgcagaacagatgctgaaagaattagttccgggtgttgcaattaatagtcgcctgcgtgcagatgataaaggtaaacgtcattttgatagcaatggccgtctgatgggcgattatgaaagtggttatgaacgtcgtctgccggaccctgtgaaagatctgaaagtgacccagtgggattgggaagcatgcatgaccattccggaaaatcagtggggctatcataaagattggagtctgagttatgttaaaaccccgattgaagtgattgatcgtattgtgcatgccgttagcatgggtggtaatatggtggtgaattttggtccgcaggcagatggtgattttcgtccggaagaaaaagcaatggcaaccgcaattggtaaatggatgaatcgctatggtaaagcagtttatgcctgtgattatgccggttttgaaaaacaggattggggttattatacccgcggtaaaaatgatgaagtttatatggttgtgttcaaccagccgtatagcgaacgtctgattgttaaaacccctaaaggtattaccgtggaaaaagcaaccctgctgaccaccggcgaagatattaccgttgtggaaaccacccgtaatgaatataatgttagtgttccgaaaaagaacccgggcgaaccgtatgttattcagctgaaagttcgtgcagccaaaggcaccaaaagtatttatcgtgatgccctgacgggatccacccaccatgattcactcaatactgtaaaagcggaggagaagactgttcaggttcagaaaggattaccttctatcgatagcttgcattatctgtcagagaatagcaaaaaagaatttaaagaagaactctcaaaagcggggcaagaatctcaaaaggtcaaagagatattagcaaaagctcagcaggcagataaacaagctcaagaacttgccaaaatgaaaattcctgagaaaataccgatgaaaccgttacatggttctctctacggtggttactttagaacttggcatgacaaaacatcagatccaacagaaaaagacaaagttaactcgatgggagagcttcctaaagaagtagatctagcctttattttccacgattggacaaaagattatagccttttttggaaagaattggccaccaaacatgtgccaaagttaaacaagcaagggacacgtgtcattcgtaccattccatggcgtttcctagctgggggtgataacagtggtattgcagaagataccagtaaatacccaaatacaccagagggaaataaagctttagccaaagctattgttgatgaatatgtttataaatacaaccttgatggcttagatgtgcaggttgaacatgatagtattccaaaagttgacaaaaaagaagatacagcaggcgtagaacgctctattcaagtgtttgaagaaattgggaaattaattggaccaaaaggtgttgataaatcgcggttatttattatggatagcacctacatggctgataaaaacccattgattgagcgaggagctccttatattaatttattactggtacaggtctatggttcacaaggagagaaaggtggttgggagcctgtttctaatcgacctgaaaaaacaatggaagaacgatggcaaggttatagcaagtatattcgtcctgaacaatacatgattggtttttctttctatgaggaaaatgctcaagaagggaatctttggtatgatattaattctcgcaaggacgaggacaaagcaaatggaattaacactgacataactggaacgcgtgccgaacggtatgcaaggtggcaacctaagacaggtggggttaagggaggtatcttctcctacgctattgaccgagatggtgtagctcatcaacctaaaaaatatgctaaacagaaagagtttaaggacgcaactgataacatcttccactcagattatagtgtctccaaggcattaaagacagttatgctaaaagataagtcgtatgatctgattgatgagaaagatttcccagataaggctttgcgagaagctgtgatggcgcaggttggaaccagaaaaggtgatttggaacgtttcaatggcacattacgattggataatccagcgattcaaagtttagaaggtctaaataaatttaaaaaattagctcaattagacttgattggcttatctcgcattacaaagctcgaccgttctgttttacccgctaatatgaagccaggcaaagataccttggaaacagttcttgaaacctataaaaaggataacaaagaagaacctgctactatcccaccagtatctttgaaggtttctggtttaactggtctgaaagaattagatttgtcaggttttgaccgtgaaaccttggctggtcttgatgccgctactctaacgtctttagaaaaagttgatatttctggcaacaaacttgatttggctccaggaacagaaaatcgacaaatttttgatactatgctatcaactatcagcaatcatgttggaagcaatgaacaaacagtgaaatttgacaagcaaaaaccaactgggcattacccagatacctatgggaaaactagtctgcgcttaccagtggcaaatgaaaaagttgatttgcaaagccagcttttgtttgggactgtgacaaatcaaggaaccctaatcaatagcgaagcagactataaggcttaccaaaatcataaaattgctggacgtagctttgttgattcaaactatcattacaataactttaaagtttcttatgagaactataccgttaaagtaactgattccacattgggaaccactactgacaaaacgctagcaactgataaagaagagacctataaggttgacttctttagcccagcagataagacaaaagctgttcatactgctaaagtgattgttggtgacgaaaaaaccatgatggttaatttggcagaaggcgcaacagttattggaggaagtgctgatcctgtaaatgcaagaaaggtatttgatgggcaactgggcagtgagactgataatatctctttaggatgggattctaagcaaagtattatatttaaattgaaagaagatggattaataaagcattggcgtttcttcaatgattcagcccgaaatcctgagacaaccaataaacctattcaggaagcaagtctacaaatttttaatatcaaagattataatctagataatttgttggaaaatcccaataaatttgatgatgaaaaatattggattactgtagatacttacagtgcacaaggagagagagctactgcattcagtaatacattaaataatattactagtaaatattggcgagttgtctttgatactaaaggagatagatatagttcgccagtagtccctgaactccaaattttaggttatccgttacctaacgccgacactatcatgaaaacagtaactactgctaaagagttatctcaacaaaaagataagttttctcaaaagatgcttgatgagttaaaaataaaagagatggctttagaaacttctttgaacagtaagatttttgatgtaactgctattaatgctaatgctggagttttgaaagattgtattgagaaaaggcagctgctaaaaaaataa

SEQ ID NO: 132 - protein, 1448 aa, Artificial Sequence
  SYNTHETIC FUSION PROTEN
MGSSHHHHHHSSGLVPRGSHMQEAKKEIPLKYGATNEGKRQDPAMQKFRDNRLGAFIHWGLYAIPGGEWNGKVYGGAAEWLKSWAKVPADEWLKLMDQWNPTKFDAKKWAKMAKEMGTKYVKITTKHHEGFCLWPSKYTKYTVANTPYKRDILGELVKAYNDEGIDVHFYFSVMDWSNPDYRYDIKSKEDSIAFSRFLEFTDNQLKELATRYPTVKDFWFDGTWDASVKKNGWWTAHAEQMLKELVPGVAINSRLRADDKGKRHFDSNGRLMGDYESGYERRLPDPVKDLKVTQWDWEACMTIPENQWGYHKDWSLSYVKTPIEVIDRIVHAVSMGGNMVVNFGPQADGDFRPEEKAMATAIGKWMNRYGKAVYACDYAGFEKQDWGYYTRGKNDEVYMVVFNQPYSERLIVKTPKGITVEKATLLTTGEDITVVETTRNEYNVSVPKKNPGEPYVIQLKVRAAKGTKSIYRDALTGSTHHDSLNTVKAEEKTVQVQKGLPSIDSLHYLSENSKKEFKEELSKAGQESQKVKEILAKAQQADKQAQELAKMKIPEKIPMKPLHGSLYGGYFRTWHDKTSDPTEKDKVNSMGELPKEVDLAFIFHDWTKDYSLFWKELATKHVPKLNKQGTRVIRTIPWRFLAGGDNSGIAEDTSKYPNTPEGNKALAKAIVDEYVYKYNLDGLDVQVEHDSIPKVDKKEDTAGVERSIQVFEEIGKLIGPKGVDKSRLFIMDSTYMADKNPLIERGAPYINLLLVQVYGSQGEKGGWEPVSNRPEKTMEERWQGYSKYIRPEQYMIGFSFYEENAQEGNLWYDINSRKDEDKANGINTDITGTRAERYARWQPKTGGVKGGIFSYAIDRDGVAHQPKKYAKQKEFKDATDNIFHSDYSVSKALKTVMLKDKSYDLIDEKDFPDKALREAVMAQVGTRKGDLERFNGTLRLDNPAIQSLEGLNKFKKLAQLDLIGLSRITKLDRSVLPANMKPGKDTLETVLETYKKDNKEEPATIPPVSLKVSGLTGLKELDLSGFDRETLAGLDAATLTSLEKVDISGNKLDLAPGTENRQIFDTMLSTISNHVGSNEQTVKFDKQKPTGHYPDTYGKTSLRLPVANEKVDLQSQLLFGTVTNQGTLINSEADYKAYQNHKIAGRSFVDSNYHYNNFKVSYENYTVKVTDSTLGTTTDKTLATDKEETYKVDFFSPADKTKAVHTAKVIVGDEKTMMVNLAEGATVIGGSADPVNARKVFDGQLGSETDNISLGWDSKQSIIFKLKEDGLIKHWRFFNDSARNPETTNKPIQEASLQIFNIKDYNLDNLLENPNKFDDEKYWITVDTYSAQGERATAFSNTLNNITSKYWRVVFDTKGDRYSSPVVPELQILGYPLPNADTIMKTVTTAKELSQQKDKFSQKMLDELKIKEMALETSLNSKIFDVTAINANAGVLKDCIEKRQLLKK

SEQ ID NO: 133 - DNA, 3858 bp, Artificial Sequence
  SYNTHETIC FUSION PROTEN
atgggcagcagccatcatcatcatcatcacagcagcggcctggtgccgcgcggcagccatatgcaggaagcaaaaaaagaaattccgctgaaatatggcgccaccaatgaaggtaaacgtcaggaccctgccatgcagaaatttcgtgataatcgtctgggcgcatttattcattggggcctgtatgcaattccgggtggtgaatggaatggtaaagtgtatggtggtgcagcagaatggctgaaaagttgggcaaaagttccggccgatgaatggctgaagctgatggatcagtggaatccgaccaaatttgatgcaaaaaaatgggccaaaatggccaaagaaatgggcaccaaatatgtgaaaattaccaccaaacatcacgaaggcttttgcctgtggccgagtaaatataccaaatataccgtggccaataccccgtataaacgtgatattctgggcgaactggttaaagcctataatgatgaaggtattgatgttcatttctactttagcgtgatggattggagcaatccggattatcgttatgatattaaaagcaaagaggacagtatcgcctttagtcgctttctggaatttaccgataatcagctgaaagaactggccacccgttatccgaccgttaaagatttttggtttgatggtacctgggatgcaagcgtgaaaaaaaatggttggtggaccgcacatgcagaacagatgctgaaagaattagttccgggtgttgcaattaatagtcgcctgcgtgcagatgataaaggtaaacgtcattttgatagcaatggccgtctgatgggcgattatgaaagtggttatgaacgtcgtctgccggaccctgtgaaagatctgaaagtgacccagtgggattgggaagcatgcatgaccattccggaaaatcagtggggctatcataaagattggagtctgagttatgttaaaaccccgattgaagtgattgatcgtattgtgcatgccgttagcatgggtggtaatatggtggtgaattttggtccgcaggcagatggtgattttcgtccggaagaaaaagcaatggcaaccgcaattggtaaatggatgaatcgctatggtaaagcagtttatgcctgtgattatgccggttttgaaaaacaggattggggttattatacccgcggtaaaaatgatgaagtttatatggttgtgttcaaccagccgtatagcgaacgtctgattgttaaaacccctaaaggtattaccgtggaaaaagcaaccctgctgaccaccggcgaagatattaccgttgtggaaaccacccgtaatgaatataatgttagtgttccgaaaaagaacccgggcgaaccgtatgttattcagctgaaagttcgtgcagccaaaggcaccaaaagtatttatcgtgatgccctgacgggatccgaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcagacaattggtgttaacgaattaaatggacgtacaggtttatctaaagattatcctgatactcctgaggggaacaaagctttagcagcagccattgtcaaggcatttgtaactgatcgtggtgtcgatggactagatattgatattgagcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggattaa

SEQ ID NO: 134 - protein, 1285 aa, Artificial Sequence
  SYNTHETIC FUSION PROTEN
MGSSHHHHHHSSGLVPRGSHMQEAKKEIPLKYGATNEGKRQDPAMQKFRDNRLGAFIHWGLYAIPGGEWNGKVYGGAAEWLKSWAKVPADEWLKLMDQWNPTKFDAKKWAKMAKEMGTKYVKITTKHHEGFCLWPSKYTKYTVANTPYKRDILGELVKAYNDEGIDVHFYFSVMDWSNPDYRYDIKSKEDSIAFSRFLEFTDNQLKELATRYPTVKDFWFDGTWDASVKKNGWWTAHAEQMLKELVPGVAINSRLRADDKGKRHFDSNGRLMGDYESGYERRLPDPVKDLKVTQWDWEACMTIPENQWGYHKDWSLSYVKTPIEVIDRIVHAVSMGGNMVVNFGPQADGDFRPEEKAMATAIGKWMNRYGKAVYACDYAGFEKQDWGYYTRGKNDEVYMVVFNQPYSERLIVKTPKGITVEKATLLTTGEDITVVETTRNEYNVSVPKKNPGEPYVIQLKVRAAKGTKSIYRDALTGSEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQTIGVNELNGRTGLSKDYPDTPEGNKALAAAIVKAFVTDRGVDGLDIDIEHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKD

SEQ ID NO: 135 - DNA, 3858 bp, Artificial Sequence
  SYNTHETIC FUSION PROTEN
atgggcagcagccatcatcatcatcatcacagcagcggcctggtgccgcgcggcagccatatgcaggaagcaaaaaaagaaattccgctgaaatatggcgccaccaatgaaggtaaacgtcaggaccctgccatgcagaaatttcgtgataatcgtctgggcgcatttattcattggggcctgtatgcaattccgggtggtgaatggaatggtaaagtgtatggtggtgcagcagaatggctgaaaagttgggcaaaagttccggccgatgaatggctgaagctgatggatcagtggaatccgaccaaatttgatgcaaaaaaatgggccaaaatggccaaagaaatgggcaccaaatatgtgaaaattaccaccaaacatcacgaaggcttttgcctgtggccgagtaaatataccaaatataccgtggccaataccccgtataaacgtgatattctgggcgaactggttaaagcctataatgatgaaggtattgatgttcatttctactttagcgtgatggattggagcaatccggattatcgttatgatattaaaagcaaagaggacagtatcgcctttagtcgctttctggaatttaccgataatcagctgaaagaactggccacccgttatccgaccgttaaagatttttggtttgatggtacctgggatgcaagcgtgaaaaaaaatggttggtggaccgcacatgcagaacagatgctgaaagaattagttccgggtgttgcaattaatagtcgcctgcgtgcagatgataaaggtaaacgtcattttgatagcaatggccgtctgatgggcgattatgaaagtggttatgaacgtcgtctgccggaccctgtgaaagatctgaaagtgacccagtgggattgggaagcatgcatgaccattccggaaaatcagtggggctatcataaagattggagtctgagttatgttaaaaccccgattgaagtgattgatcgtattgtgcatgccgttagcatgggtggtaatatggtggtgaattttggtccgcaggcagatggtgattttcgtccggaagaaaaagcaatggcaaccgcaattggtaaatggatgaatcgctatggtaaagcagtttatgcctgtgattatgccggttttgaaaaacaggattggggttattatacccgcggtaaaaatgatgaagtttatatggttgtgttcaaccagccgtatagcgaacgtctgattgttaaaacccctaaaggtattaccgtggaaaaagcaaccctgctgaccaccggcgaagatattaccgttgtggaaaccacccgtaatgaatataatgttagtgttccgaaaaagaacccgggcgaaccgtatgttattcagctgaaagttcgtgcagccaaaggcaccaaaagtatttatcgtgatgccctgacgggatccgaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcaggaaattggtgttaacgaattaaatggacgtacaggtttatctaaagattatcctgatactcctgaggggaacaaagctttagcagcagccattgtcaaggcatttgtaactgatcgtggtgtcgatggactagatattgatattgagcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggattaa

SEQ ID NO: 136 - protein, 1285 aa, Artificial Sequence
  SYNTHETIC FUSION PROTEN
MGSSHHHHHHSSGLVPRGSHMQEAKKEIPLKYGATNEGKRQDPAMQKFRDNRLGAFIHWGLYAIPGGEWNGKVYGGAAEWLKSWAKVPADEWLKLMDQWNPTKFDAKKWAKMAKEMGTKYVKITTKHHEGFCLWPSKYTKYTVANTPYKRDILGELVKAYNDEGIDVHFYFSVMDWSNPDYRYDIKSKEDSIAFSRFLEFTDNQLKELATRYPTVKDFWFDGTWDASVKKNGWWTAHAEQMLKELVPGVAINSRLRADDKGKRHFDSNGRLMGDYESGYERRLPDPVKDLKVTQWDWEACMTIPENQWGYHKDWSLSYVKTPIEVIDRIVHAVSMGGNMVVNFGPQADGDFRPEEKAMATAIGKWMNRYGKAVYACDYAGFEKQDWGYYTRGKNDEVYMVVFNQPYSERLIVKTPKGITVEKATLLTTGEDITVVETTRNEYNVSVPKKNPGEPYVIQLKVRAAKGTKSIYRDALTGSEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQEIGVNELNGRTGLSKDYPDTPEGNKALAAAIVKAFVTDRGVDGLDIDIEHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKD

SEQ ID NO: 137 - DNA, 3858 bp, Artificial Sequence
  SYNTHETIC FUSION PROTEN
atgggcagcagccatcatcatcatcatcacagcagcggcctggtgccgcgcggcagccatatgcaggaagcaaaaaaagaaattccgctgaaatatggcgccaccaatgaaggtaaacgtcaggaccctgccatgcagaaatttcgtgataatcgtctgggcgcatttattcattggggcctgtatgcaattccgggtggtgaatggaatggtaaagtgtatggtggtgcagcagaatggctgaaaagttgggcaaaagttccggccgatgaatggctgaagctgatggatcagtggaatccgaccaaatttgatgcaaaaaaatgggccaaaatggccaaagaaatgggcaccaaatatgtgaaaattaccaccaaacatcacgaaggcttttgcctgtggccgagtaaatataccaaatataccgtggccaataccccgtataaacgtgatattctgggcgaactggttaaagcctataatgatgaaggtattgatgttcatttctactttagcgtgatggattggagcaatccggattatcgttatgatattaaaagcaaagaggacagtatcgcctttagtcgctttctggaatttaccgataatcagctgaaagaactggccacccgttatccgaccgttaaagatttttggtttgatggtacctgggatgcaagcgtgaaaaaaaatggttggtggaccgcacatgcagaacagatgctgaaagaattagttccgggtgttgcaattaatagtcgcctgcgtgcagatgataaaggtaaacgtcattttgatagcaatggccgtctgatgggcgattatgaaagtggttatgaacgtcgtctgccggaccctgtgaaagatctgaaagtgacccagtgggattgggaagcatgcatgaccattccggaaaatcagtggggctatcataaagattggagtctgagttatgttaaaaccccgattgaagtgattgatcgtattgtgcatgccgttagcatgggtggtaatatggtggtgaattttggtccgcaggcagatggtgattttcgtccggaagaaaaagcaatggcaaccgcaattggtaaatggatgaatcgctatggtaaagcagtttatgcctgtgattatgccggttttgaaaaacaggattggggttattatacccgcggtaaaaatgatgaagtttatatggttgtgttcaaccagccgtatagcgaacgtctgattgttaaaacccctaaaggtattaccgtggaaaaagcaaccctgctgaccaccggcgaagatattaccgttgtggaaaccacccgtaatgaatataatgttagtgttccgaaaaagaacccgggcgaaccgtatgttattcagctgaaagttcgtgcagccaaaggcaccaaaagtatttatcgtgatgccctgacgggatccgaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcagatgattggtgttaacgaattaaatggacgtacaggtttatctaaagattatcctgatactcctgaggggaacaaagctttagcagcagccattgtcaaggcatttgtaactgatcgtggtgtcgatggactagatattgatattgagcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggattaa

SEQ ID NO: 138 - protein, 1285 aa, Artificial Sequence
  SYNTHETIC FUSION PROTEN
MGSSHHHHHHSSGLVPRGSHMQEAKKEIPLKYGATNEGKRQDPAMQKFRDNRLGAFIHWGLYAIPGGEWNGKVYGGAAEWLKSWAKVPADEWLKLMDQWNPTKFDAKKWAKMAKEMGTKYVKITTKHHEGFCLWPSKYTKYTVANTPYKRDILGELVKAYNDEGIDVHFYFSVMDWSNPDYRYDIKSKEDSIAFSRFLEFTDNQLKELATRYPTVKDFWFDGTWDASVKKNGWWTAHAEQMLKELVPGVAINSRLRADDKGKRHFDSNGRLMGDYESGYERRLPDPVKDLKVTQWDWEACMTIPENQWGYHKDWSLSYVKTPIEVIDRIVHAVSMGGNMVVNFGPQADGDFRPEEKAMATAIGKWMNRYGKAVYACDYAGFEKQDWGYYTRGKNDEVYMVVFNQPYSERLIVKTPKGITVEKATLLTTGEDITVVETTRNEYNVSVPKKNPGEPYVIQLKVRAAKGTKSIYRDALTGSEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQMIGVNELNGRTGLSKDYPDTPEGNKALAAAIVKAFVTDRGVDGLDIDIEHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKD

SEQ ID NO: 139 - DNA, 3858 bp, Artificial Sequence
  SYNTHETIC FUSION PROTEN
atgggcagcagccatcatcatcatcatcacagcagcggcctggtgccgcgcggcagccatatgcaggaagcaaaaaaagaaattccgctgaaatatggcgccaccaatgaaggtaaacgtcaggaccctgccatgcagaaatttcgtgataatcgtctgggcgcatttattcattggggcctgtatgcaattccgggtggtgaatggaatggtaaagtgtatggtggtgcagcagaatggctgaaaagttgggcaaaagttccggccgatgaatggctgaagctgatggatcagtggaatccgaccaaatttgatgcaaaaaaatgggccaaaatggccaaagaaatgggcaccaaatatgtgaaaattaccaccaaacatcacgaaggcttttgcctgtggccgagtaaatataccaaatataccgtggccaataccccgtataaacgtgatattctgggcgaactggttaaagcctataatgatgaaggtattgatgttcatttctactttagcgtgatggattggagcaatccggattatcgttatgatattaaaagcaaagaggacagtatcgcctttagtcgctttctggaatttaccgataatcagctgaaagaactggccacccgttatccgaccgttaaagatttttggtttgatggtacctgggatgcaagcgtgaaaaaaaatggttggtggaccgcacatgcagaacagatgctgaaagaattagttccgggtgttgcaattaatagtcgcctgcgtgcagatgataaaggtaaacgtcattttgatagcaatggccgtctgatgggcgattatgaaagtggttatgaacgtcgtctgccggaccctgtgaaagatctgaaagtgacccagtgggattgggaagcatgcatgaccattccggaaaatcagtggggctatcataaagattggagtctgagttatgttaaaaccccgattgaagtgattgatcgtattgtgcatgccgttagcatgggtggtaatatggtggtgaattttggtccgcaggcagatggtgattttcgtccggaagaaaaagcaatggcaaccgcaattggtaaatggatgaatcgctatggtaaagcagtttatgcctgtgattatgccggttttgaaaaacaggattggggttattatacccgcggtaaaaatgatgaagtttatatggttgtgttcaaccagccgtatagcgaacgtctgattgttaaaacccctaaaggtattaccgtggaaaaagcaaccctgctgaccaccggcgaagatattaccgttgtggaaaccacccgtaatgaatataatgttagtgttccgaaaaagaacccgggcgaaccgtatgttattcagctgaaagttcgtgcagccaaaggcaccaaaagtatttatcgtgatgccctgacgggatccgaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcagacaattggtgttaacgaattaaatggacgtacaggtttatctaaagattatcctgatactcctgaggggaacaaagctttagcagcagccattgtcaaggcatttgtaactgatcgtggtgtcgatggactagatattatgattgagcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggattaa

SEQ ID NO: 140 - protein, 1285 aa, Artificial Sequence
  SYNTHETIC FUSION PROTEN
MGSSHHHHHHSSGLVPRGSHMQEAKKEIPLKYGATNEGKRQDPAMQKFRDNRLGAFIHWGLYAIPGGEWNGKVYGGAAEWLKSWAKVPADEWLKLMDQWNPTKFDAKKWAKMAKEMGTKYVKITTKHHEGFCLWPSKYTKYTVANTPYKRDILGELVKAYNDEGIDVHFYFSVMDWSNPDYRYDIKSKEDSIAFSRFLEFTDNQLKELATRYPTVKDFWFDGTWDASVKKNGWWTAHAEQMLKELVPGVAINSRLRADDKGKRHFDSNGRLMGDYESGYERRLPDPVKDLKVTQWDWEACMTIPENQWGYHKDWSLSYVKTPIEVIDRIVHAVSMGGNMVVNFGPQADGDFRPEEKAMATAIGKWMNRYGKAVYACDYAGFEKQDWGYYTRGKNDEVYMVVFNQPYSERLIVKTPKGITVEKATLLTTGEDITVVETTRNEYNVSVPKKNPGEPYVIQLKVRAAKGTKSIYRDALTGSEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQTIGVNELNGRTGLSKDYPDTPEGNKALAAAIVKAFVTDRGVDGLDIMIEHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKD

SEQ ID NO: 141 - DNA, 3063 bp, Artificial Sequence
  SYNTHETIC FUSION PROTEN
atgggcagcagccatcatcatcatcatcacagcagcggcctggtgccgcgcggcagccatatgggtaccctgcagggatccaaagataagtcgtatgatctgattgatgagaaagatttcccagataaggctttgcgagaagctgtgatggcgcaggttggaaccagaaaaggtgatttggaacgtttcaatggcacattacgattggataatccagcgattcaaagtttagaaggtctaaataaatttaaaaaattagctcaattagacttgattggcttatctcgcattacaaagctcgaccgttctgttttacccgctaatatgaagccaggcaaagataccttggaaacagttcttgaaacctataaaaaggataacaaagaagaacctgctactatcccaccagtatctttgaaggtttctggtttaactggtctgaaagaattagatttgtcaggttttgaccgtgaaaccttggctggtcttgatgccgctactctaacgtctttagaaaaagttgatatttctggcaacaaacttgatttggctccaggaacagaaaatcgacaaatttttgatactatgctatcaactatcagcaatcatgttggaagcaatgaacaaacagtgaaatttgacaagcaaaaaccaactgggcattacccagatacctatgggaaaactagtctgcgcttaccagtggcaaatgaaaaagttgatttgcaaagccagcttttgtttgggactgtgacaaatcaaggaaccctaatcaatagcgaagcagactataaggcttaccaaaatcataaaattgctggacgtagctttgttgattcaaactatcattacaataactttaaagtttcttatgagaactataccgttaaagtaactgattccacattgggaaccactactgacaaaacgctagcaactgataaagaagagacctataaggttgacttctttagcccagcagataagacaaaagctgttcatactgctaaagtgattgttggtgacgaaaaaaccatgatggttaatttggcagaaggcgcaacagttattggaggaagtgctgatcctgtaaatgcaagaaaggtatttgatgggcaactgggcagtgagactgataatatctctttaggatgggattctaagcaaagtattatatttaaattgaaagaagatggattaataaagcattggcgtttcttcaatgattcagcccgaaatcctgagacaaccaataaacctattcaggaagcaagtctacaaatttttaatatcaaagattataatctagataatttgttggaaaatcccaataaatttgatgatgaaaaatattggattactgtagatacttacagtgcacaaggagagagagctactgcattcagtaatacattaaataatattactagtaaatattggcgagttgtctttgatactaaaggagatagatatagttcgccagtagtccctgaactccaaattttaggttatccgttacctaacgccgacactatcatgaaaacagtaactactgctaaagagttatctcaacaaaaagataagttttctcaaaagatgcttgatgagttaaaaataaaagagatggctttagaaacttctttgaacagtaagatttttgatgtaactgctattaatgctaatgctggagttttgaaagattgtattgagaaaaggcagctgctaaaaaaaggcggtgcacagtatcaggcaaattggcagagtctggatcagcgcccgaccccggcatggtttgaagatgccaaatttggcatttttatccattggggcctgtatagtgtgccgagctgggcaaccaaaagtaatgccgatggctttggtagcggctatagtgaatggtattggcagcgtctgtttgcaaaaaatctgaaaattcatccggaatttgtggaatttcataaaaaaaacttcggcgataagaactatcaggattttgtgcagaattttaaggcagaactgtttcagccgaatgattgggcaaatatttttgaacaggcaggcgccaaatatgttgtgctgaccagtaaacatcatgaaggttttaccctgtggccgagcaaagaaagctggaattggaatagtgttgatgtgggcccgcatcgtgatctggcaggtgatctgatgaccgccgtgcgtgcaaaaaatttaaaaatgggttattactacagcctgtatgaatggtttaatccggtttataaagccgatgtgaatacctatgttagcgaacgtatgctgccgcagatgaaagatctggttacccgctataaaccggatattctgtggaccgatggcgaatgggattatccggcaaaaacctggcgtagcgaagaatttctggcatggctgtttaatgaaagtaatgttaaaaacgagatcgtggttaatgatcgttggggtagtgataccaaaagcaaacatggtagctttgccaccagtgaatatggccacggtggtaccgataataccgaaaccaccggtggctttcagcgtccgtgggaagaatgccgtggtatgggtgaaagttttggctataatcgtaatgaaaacctggatagctatcagaccggcgaagcactggtgcatcagctgattgatattgttgccaaaggcggtaatctgctgctgaatattggcccggcagccgatggcaccattccggttattatgcaggaacgcctgcatgaaattggcagctggctgaaagttaatggcagcgcaatttatggcacccgtcgctggagcaaagcaccggcatataccaaagaaagtaccctgtattttacccagaaaggtaaaaatctgaacgcaattacccgcaaatgggaagaaaccattagcattcagaatgtggcaaaaccgagtaaagttaccctgctgggttataaaggtgaagttaaatttacctacaagaacggtaccctgaccattatggccccgagcgtgaatccgagcaatattccgtgtcagtatgcctggacctatgaaattgaaaatgcactgtaa

SEQ ID NO: 142 - protein, 1020 aa, Artificial Sequence
  SYNTHETIC FUSION PROTEN
MGSSHHHHHHSSGLVPRGSHMGTLQGSKDKSYDLIDEKDFPDKALREAVMAQVGTRKGDLERFNGTLRLDNPAIQSLEGLNKFKKLAQLDLIGLSRITKLDRSVLPANMKPGKDTLETVLETYKKDNKEEPATIPPVSLKVSGLTGLKELDLSGFDRETLAGLDAATLTSLEKVDISGNKLDLAPGTENRQIFDTMLSTISNHVGSNEQTVKFDKQKPTGHYPDTYGKTSLRLPVANEKVDLQSQLLFGTVTNQGTLINSEADYKAYQNHKIAGRSFVDSNYHYNNFKVSYENYTVKVTDSTLGTTTDKTLATDKEETYKVDFFSPADKTKAVHTAKVIVGDEKTMMVNLAEGATVIGGSADPVNARKVFDGQLGSETDNISLGWDSKQSIIFKLKEDGLIKHWRFFNDSARNPETTNKPIQEASLQIFNIKDYNLDNLLENPNKFDDEKYWITVDTYSAQGERATAFSNTLNNITSKYWRVVFDTKGDRYSSPVVPELQILGYPLPNADTIMKTVTTAKELSQQKDKFSQKMLDELKIKEMALETSLNSKIFDVTAINANAGVLKDCIEKRQLLKKGGAQYQANWQSLDQRPTPAWFEDAKFGIFIHWGLYSVPSWATKSNADGFGSGYSEWYWQRLFAKNLKIHPEFVEFHKKNFGDKNYQDFVQNFKAELFQPNDWANIFEQAGAKYVVLTSKHHEGFTLWPSKESWNWNSVDVGPHRDLAGDLMTAVRAKNLKMGYYYSLYEWFNPVYKADVNTYVSERMLPQMKDLVTRYKPDILWTDGEWDYPAKTWRSEEFLAWLFNESNVKNEIVVNDRWGSDTKSKHGSFATSEYGHGGTDNTETTGGFQRPWEECRGMGESFGYNRNENLDSYQTGEALVHQLIDIVAKGGNLLLNIGPAADGTIPVIMQERLHEIGSWLKVNGSAIYGTRRWSKAPAYTKESTLYFTQKGKNLNAITRKWEETISIQNVAKPSKVTLLGYKGEVKFTYKNGTLTIMAPSVNPSNIPCQYAWTYEIENAL

SEQ ID NO: 143 - DNA, 2790 bp, Artificial Sequence
  SYNTHETIC FUSION PROTEN
atgggcagcagccatcatcatcatcatcacagcagcggcctggtgccgcgcggcagccatatgggtaccctgcagggatccaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggatggcggtgcacagtatcaggcaaattggcagagtctggatcagcgcccgaccccggcatggtttgaagatgccaaatttggcatttttatccattggggcctgtatagtgtgccgagctgggcaaccaaaagtaatgccgatggctttggtagcggctatagtgaatggtattggcagcgtctgtttgcaaaaaatctgaaaattcatccggaatttgtggaatttcataaaaaaaacttcggcgataagaactatcaggattttgtgcagaattttaaggcagaactgtttcagccgaatgattgggcaaatatttttgaacaggcaggcgccaaatatgttgtgctgaccagtaaacatcatgaaggttttaccctgtggccgagcaaagaaagctggaattggaatagtgttgatgtgggcccgcatcgtgatctggcaggtgatctgatgaccgccgtgcgtgcaaaaaatttaaaaatgggttattactacagcctgtatgaatggtttaatccggtttataaagccgatgtgaatacctatgttagcgaacgtatgctgccgcagatgaaagatctggttacccgctataaaccggatattctgtggaccgatggcgaatgggattatccggcaaaaacctggcgtagcgaagaatttctggcatggctgtttaatgaaagtaatgttaaaaacgagatcgtggttaatgatcgttggggtagtgataccaaaagcaaacatggtagctttgccaccagtgaatatggccacggtggtaccgataataccgaaaccaccggtggctttcagcgtccgtgggaagaatgccgtggtatgggtgaaagttttggctataatcgtaatgaaaacctggatagctatcagaccggcgaagcactggtgcatcagctgattgatattgttgccaaaggcggtaatctgctgctgaatattggcccggcagccgatggcaccattccggttattatgcaggaacgcctgcatgaaattggcagctggctgaaagttaatggcagcgcaatttatggcacccgtcgctggagcaaagcaccggcatataccaaagaaagtaccctgtattttacccagaaaggtaaaaatctgaacgcaattacccgcaaatgggaagaaaccattagcattcagaatgtggcaaaaccgagtaaagttaccctgctgggttataaaggtgaagttaaatttacctacaagaacggtaccctgaccattatggccccgagcgtgaatccgagcaatattccgtgtcagtatgcctggacctatgaaattgaaaatgcactgtaa

SEQ ID NO: 144 - protein, 929 aa, Artificial Sequence
  SYNTHETIC FUSION PROTEN
MGSSHHHHHHSSGLVPRGSHMGTLQGSTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKDGGAQYQANWQSLDQRPTPAWFEDAKFGIFIHWGLYSVPSWATKSNADGFGSGYSEWYWQRLFAKNLKIHPEFVEFHKKNFGDKNYQDFVQNFKAELFQPNDWANIFEQAGAKYVVLTSKHHEGFTLWPSKESWNWNSVDVGPHRDLAGDLMTAVRAKNLKMGYYYSLYEWFNPVYKADVNTYVSERMLPQMKDLVTRYKPDILWTDGEWDYPAKTWRSEEFLAWLFNESNVKNEIVVNDRWGSDTKSKHGSFATSEYGHGGTDNTETTGGFQRPWEECRGMGESFGYNRNENLDSYQTGEALVHQLIDIVAKGGNLLLNIGPAADGTIPVIMQERLHEIGSWLKVNGSAIYGTRRWSKAPAYTKESTLYFTQKGKNLNAITRKWEETISIQNVAKPSKVTLLGYKGEVKFTYKNGTLTIMAPSVNPSNIPCQYAWTYEIENAL

SEQ ID NO: 145 - DNA, 4338 bp, Artificial Sequence
  SYNTHETIC FUSION PROTEN
atgggcagcagccatcatcatcatcatcacagcagcggcctggtgccgcgcggcagccatatgacccaccatgattcactcaatactgtaaaagcggaggagaagactgttcaggttcagaaaggattaccttctatcgatagcttgcattatctgtcagagaatagcaaaaaagaatttaaagaagaactctcaaaagcggggcaagaatctcaaaaggtcaaagagatattagcaaaagctcagcaggcagataaacaagctcaagaacttgccaaaatgaaaattcctgagaaaataccgatgaaaccgttacatggttctctctacggtggttactttagaacttggcatgacaaaacatcagatccaacagaaaaagacaaagttaactcgatgggagagcttcctaaagaagtagatctagcctttattttccacgattggacaaaagattatagccttttttggaaagaattggccaccaaacatgtgccaaagttaaacaagcaagggacacgtgtcattcgtaccattccatggcgtttcctagctgggggtgataacagtggtattgcagaagataccagtaaatacccaaatacaccagagggaaataaagctttagccaaagctattgttgatgaatatgtttataaatacaaccttgatggcttagatgtggatgttgaacatgatagtattccaaaagttgacaaaaaagaagatacagcaggcgtagaacgctctattcaagtgtttgaagaaattgggaaattaattggaccaaaaggtgttgataaatcgcggttatttattatggatagcacctacatggctgataaaaacccattgattgagcgaggagctccttatattaatttattactggtacaggtctatggttcacaaggagagaaaggtggttgggagcctgtttctaatcgacctgaaaaaacaatggaagaacgatggcaaggttatagcaagtatattcgtcctgaacaatacatgattggtttttctttctatgaggaaaatgctcaagaagggaatctttggtatgatattaattctcgcaaggacgaggacaaagcaaatggaattaacactgacataactggaacgcgtgccgaacggtatgcaaggtggcaacctaagacaggtggggttaagggaggtatcttctcctacgctattgaccgagatggtgtagctcatcaacctaaaaaatatgctaaacagaaagagtttaaggacgcaactgataacatcttccactcagattatagtgtctccaaggcattaaagacagttatgctaaaagataagtcgtatgatctgattgatgagaaagatttcccagataaggctttgcgagaagctgtgatggcgcaggttggaaccagaaaaggtgatttggaacgtttcaatggcacattacgattggataatccagcgattcaaagtttagaaggtctaaataaatttaaaaaattagctcaattagacttgattggcttatctcgcattacaaagctcgaccgttctgttttacccgctaatatgaagccaggcaaagataccttggaaacagttcttgaaacctataaaaaggataacaaagaagaacctgctactatcccaccagtatctttgaaggtttctggtttaactggtctgaaagaattagatttgtcaggttttgaccgtgaaaccttggctggtcttgatgccgctactctaacgtctttagaaaaagttgatatttctggcaacaaacttgatttggctccaggaacagaaaatcgacaaatttttgatactatgctatcaactatcagcaatcatgttggaagcaatgaacaaacagtgaaatttgacaagcaaaaaccaactgggcattacccagatacctatgggaaaactagtctgcgcttaccagtggcaaatgaaaaagttgatttgcaaagccagcttttgtttgggactgtgacaaatcaaggaaccctaatcaatagcgaagcagactataaggcttaccaaaatcataaaattgctggacgtagctttgttgattcaaactatcattacaataactttaaagtttcttatgagaactataccgttaaagtaactgattccacattgggaaccactactgacaaaacgctagcaactgataaagaagagacctataaggttgacttctttagcccagcagataagacaaaagctgttcatactgctaaagtgattgttggtgacgaaaaaaccatgatggttaatttggcagaaggcgcaacagttattggaggaagtgctgatcctgtaaatgcaagaaaggtatttgatgggcaactgggcagtgagactgataatatctctttaggatgggattctaagcaaagtattatatttaaattgaaagaagatggattaataaagcattggcgtttcttcaatgattcagcccgaaatcctgagacaaccaataaacctattcaggaagcaagtctacaaatttttaatatcaaagattataatctagataatttgttggaaaatcccaataaatttgatgatgaaaaatattggattactgtagatacttacagtgcacaaggagagagagctactgcattcagtaatacattaaataatattactagtaaatattggcgagttgtctttgatactaaaggagatagatatagttcgccagtagtccctgaactccaaattttaggttatccgttacctaacgccgacactatcatgaaaacagtaactactgctaaagagttatctcaacaaaaagataagttttctcaaaagatgcttgatgagttaaaaataaaagagatggctttagaaacttctttgaacagtaagatttttgatgtaactgctattaatgctaatgctggagttttgaaagattgtattgagaaaaggcagctgctaaaaaaaggatccggtgctcagtatcaggcaaattggcagagtctggatcagcgcccgaccccggcatggtttgaagatgccaaatttggcatttttatccattggggcctgtatagtgtgccgagctgggcaaccaaaagtaatgccgatggctttggtagcggctatagtgaatggtattggcagcgtctgtttgcaaaaaatctgaaaattcatccggaatttgtggaatttcataaaaaaaacttcggcgataagaactatcaggattttgtgcagaattttaaggcagaactgtttcagccgaatgattgggcaaatatttttgaacaggcaggcgccaaatatgttgtgctgaccagtaaacatcatgaaggttttaccctgtggccgagcaaagaaagctggaattggaatagtgttgatgtgggcccgcatcgtgatctggcaggtgatctgatgaccgccgtgcgtgcaaaaaatttaaaaatgggttattactacagcctgtatgaatggtttaatccggtttataaagccgatgtgaatacctatgttagcgaacgtatgctgccgcagatgaaagatctggttacccgctataaaccggatattctgtggaccgatggcgaatgggattatccggcaaaaacctggcgtagcgaagaatttctggcatggctgtttaatgaaagtaatgttaaaaacgagatcgtggttaatgatcgttggggtagtgataccaaaagcaaacatggtagctttgccaccagtgaatatggccacggtggtaccgataataccgaaaccaccggtggctttcagcgtccgtgggaagaatgccgtggtatgggtgaaagttttggctataatcgtaatgaaaacctggatagctatcagaccggcgaagcactggtgcatcagctgattgatattgttgccaaaggcggtaatctgctgctgaatattggcccggcagccgatggcaccattccggttattatgcaggaacgcctgcatgaaattggcagctggctgaaagttaatggcagcgcaatttatggcacccgtcgctggagcaaagcaccggcatataccaaagaaagtaccctgtattttacccagaaaggtaaaaatctgaacgcaattacccgcaaatgggaagaaaccattagcattcagaatgtggcaaaaccgagtaaagttaccctgctgggttataaaggtgaagttaaatttacctacaagaacggtaccctgaccattatggccccgagcgtgaatccgagcaatattccgtgtcagtatgcctggacctatgaaattgaaaatgcactgggtacctggtctcatccgcagttcgagaaataa

SEQ ID NO: 146 - protein, 1445 aa, Artificial Sequence
  SYNTHETIC FUSION PROTEN
MGSSHHHHHHSSGLVPRGSHMTHHDSLNTVKAEEKTVQVQKGLPSIDSLHYLSENSKKEFKEELSKAGQESQKVKEILAKAQQADKQAQELAKMKIPEKIPMKPLHGSLYGGYFRTWHDKTSDPTEKDKVNSMGELPKEVDLAFIFHDWTKDYSLFWKELATKHVPKLNKQGTRVIRTIPWRFLAGGDNSGIAEDTSKYPNTPEGNKALAKAIVDEYVYKYNLDGLDVDVEHDSIPKVDKKEDTAGVERSIQVFEEIGKLIGPKGVDKSRLFIMDSTYMADKNPLIERGAPYINLLLVQVYGSQGEKGGWEPVSNRPEKTMEERWQGYSKYIRPEQYMIGFSFYEENAQEGNLWYDINSRKDEDKANGINTDITGTRAERYARWQPKTGGVKGGIFSYAIDRDGVAHQPKKYAKQKEFKDATDNIFHSDYSVSKALKTVMLKDKSYDLIDEKDFPDKALREAVMAQVGTRKGDLERFNGTLRLDNPAIQSLEGLNKFKKLAQLDLIGLSRITKLDRSVLPANMKPGKDTLETVLETYKKDNKEEPATIPPVSLKVSGLTGLKELDLSGFDRETLAGLDAATLTSLEKVDISGNKLDLAPGTENRQIFDTMLSTISNHVGSNEQTVKFDKQKPTGHYPDTYGKTSLRLPVANEKVDLQSQLLFGTVTNQGTLINSEADYKAYQNHKIAGRSFVDSNYHYNNFKVSYENYTVKVTDSTLGTTTDKTLATDKEETYKVDFFSPADKTKAVHTAKVIVGDEKTMMVNLAEGATVIGGSADPVNARKVFDGQLGSETDNISLGWDSKQSIIFKLKEDGLIKHWRFFNDSARNPETTNKPIQEASLQIFNIKDYNLDNLLENPNKFDDEKYWITVDTYSAQGERATAFSNTLNNITSKYWRVVFDTKGDRYSSPVVPELQILGYPLPNADTIMKTVTTAKELSQQKDKFSQKMLDELKIKEMALETSLNSKIFDVTAINANAGVLKDCIEKRQLLKKGSGAQYQANWQSLDQRPTPAWFEDAKFGIFIHWGLYSVPSWATKSNADGFGSGYSEWYWQRLFAKNLKIHPEFVEFHKKNFGDKNYQDFVQNFKAELFQPNDWANIFEQAGAKYVVLTSKHHEGFTLWPSKESWNWNSVDVGPHRDLAGDLMTAVRAKNLKMGYYYSLYEWFNPVYKADVNTYVSERMLPQMKDLVTRYKPDILWTDGEWDYPAKTWRSEEFLAWLFNESNVKNEIVVNDRWGSDTKSKHGSFATSEYGHGGTDNTETTGGFQRPWEECRGMGESFGYNRNENLDSYQTGEALVHQLIDIVAKGGNLLLNIGPAADGTIPVIMQERLHEIGSWLKVNGSAIYGTRRWSKAPAYTKESTLYFTQKGKNLNAITRKWEETISIQNVAKPSKVTLLGYKGEVKFTYKNGTLTIMAPSVNPSNIPCQYAWTYEIENALGTWSHPQFEK

SEQ ID NO: 147 - DNA, 4338 bp, Artificial Sequence
  SYNTHETIC FUSION PROTEN
atgggcagcagccatcatcatcatcatcacagcagcggcctggtgccgcgcggcagccatatgacccaccatgattcactcaatactgtaaaagcggaggagaagactgttcaggttcagaaaggattaccttctatcgatagcttgcattatctgtcagagaatagcaaaaaagaatttaaagaagaactctcaaaagcggggcaagaatctcaaaaggtcaaagagatattagcaaaagctcagcaggcagataaacaagctcaagaacttgccaaaatgaaaattcctgagaaaataccgatgaaaccgttacatggttctctctacggtggttactttagaacttggcatgacaaaacatcagatccaacagaaaaagacaaagttaactcgatgggagagcttcctaaagaagtagatctagcctttattttccacgattggacaaaagattatagccttttttggaaagaattggccaccaaacatgtgccaaagttaaacaagcaagggacacgtgtcattcgtaccattccatggcgtttcctagctgggggtgataacagtggtattgcagaagataccagtaaatacccaaatacaccagagggaaataaagctttagccaaagctattgttgatgaatatgtttataaatacaaccttgatggcttagatgtgcaggttgaacatgatagtattccaaaagttgacaaaaaagaagatacagcaggcgtagaacgctctattcaagtgtttgaagaaattgggaaattaattggaccaaaaggtgttgataaatcgcggttatttattatggatagcacctacatggctgataaaaacccattgattgagcgaggagctccttatattaatttattactggtacaggtctatggttcacaaggagagaaaggtggttgggagcctgtttctaatcgacctgaaaaaacaatggaagaacgatggcaaggttatagcaagtatattcgtcctgaacaatacatgattggtttttctttctatgaggaaaatgctcaagaagggaatctttggtatgatattaattctcgcaaggacgaggacaaagcaaatggaattaacactgacataactggaacgcgtgccgaacggtatgcaaggtggcaacctaagacaggtggggttaagggaggtatcttctcctacgctattgaccgagatggtgtagctcatcaacctaaaaaatatgctaaacagaaagagtttaaggacgcaactgataacatcttccactcagattatagtgtctccaaggcattaaagacagttatgctaaaagataagtcgtatgatctgattgatgagaaagatttcccagataaggctttgcgagaagctgtgatggcgcaggttggaaccagaaaaggtgatttggaacgtttcaatggcacattacgattggataatccagcgattcaaagtttagaaggtctaaataaatttaaaaaattagctcaattagacttgattggcttatctcgcattacaaagctcgaccgttctgttttacccgctaatatgaagccaggcaaagataccttggaaacagttcttgaaacctataaaaaggataacaaagaagaacctgctactatcccaccagtatctttgaaggtttctggtttaactggtctgaaagaattagatttgtcaggttttgaccgtgaaaccttggctggtcttgatgccgctactctaacgtctttagaaaaagttgatatttctggcaacaaacttgatttggctccaggaacagaaaatcgacaaatttttgatactatgctatcaactatcagcaatcatgttggaagcaatgaacaaacagtgaaatttgacaagcaaaaaccaactgggcattacccagatacctatgggaaaactagtctgcgcttaccagtggcaaatgaaaaagttgatttgcaaagccagcttttgtttgggactgtgacaaatcaaggaaccctaatcaatagcgaagcagactataaggcttaccaaaatcataaaattgctggacgtagctttgttgattcaaactatcattacaataactttaaagtttcttatgagaactataccgttaaagtaactgattccacattgggaaccactactgacaaaacgctagcaactgataaagaagagacctataaggttgacttctttagcccagcagataagacaaaagctgttcatactgctaaagtgattgttggtgacgaaaaaaccatgatggttaatttggcagaaggcgcaacagttattggaggaagtgctgatcctgtaaatgcaagaaaggtatttgatgggcaactgggcagtgagactgataatatctctttaggatgggattctaagcaaagtattatatttaaattgaaagaagatggattaataaagcattggcgtttcttcaatgattcagcccgaaatcctgagacaaccaataaacctattcaggaagcaagtctacaaatttttaatatcaaagattataatctagataatttgttggaaaatcccaataaatttgatgatgaaaaatattggattactgtagatacttacagtgcacaaggagagagagctactgcattcagtaatacattaaataatattactagtaaatattggcgagttgtctttgatactaaaggagatagatatagttcgccagtagtccctgaactccaaattttaggttatccgttacctaacgccgacactatcatgaaaacagtaactactgctaaagagttatctcaacaaaaagataagttttctcaaaagatgcttgatgagttaaaaataaaagagatggctttagaaacttctttgaacagtaagatttttgatgtaactgctattaatgctaatgctggagttttgaaagattgtattgagaaaaggcagctgctaaaaaaaggatccggtgctcagtatcaggcaaattggcagagtctggatcagcgcccgaccccggcatggtttgaagatgccaaatttggcatttttatccattggggcctgtatagtgtgccgagctgggcaaccaaaagtaatgccgatggctttggtagcggctatagtgaatggtattggcagcgtctgtttgcaaaaaatctgaaaattcatccggaatttgtggaatttcataaaaaaaacttcggcgataagaactatcaggattttgtgcagaattttaaggcagaactgtttcagccgaatgattgggcaaatatttttgaacaggcaggcgccaaatatgttgtgctgaccagtaaacatcatgaaggttttaccctgtggccgagcaaagaaagctggaattggaatagtgttgatgtgggcccgcatcgtgatctggcaggtgatctgatgaccgccgtgcgtgcaaaaaatttaaaaatgggttattactacagcctgtatgaatggtttaatccggtttataaagccgatgtgaatacctatgttagcgaacgtatgctgccgcagatgaaagatctggttacccgctataaaccggatattctgtggaccgatggcgaatgggattatccggcaaaaacctggcgtagcgaagaatttctggcatggctgtttaatgaaagtaatgttaaaaacgagatcgtggttaatgatcgttggggtagtgataccaaaagcaaacatggtagctttgccaccagtgaatatggccacggtggtaccgataataccgaaaccaccggtggctttcagcgtccgtgggaagaatgccgtggtatgggtgaaagttttggctataatcgtaatgaaaacctggatagctatcagaccggcgaagcactggtgcatcagctgattgatattgttgccaaaggcggtaatctgctgctgaatattggcccggcagccgatggcaccattccggttattatgcaggaacgcctgcatgaaattggcagctggctgaaagttaatggcagcgcaatttatggcacccgtcgctggagcaaagcaccggcatataccaaagaaagtaccctgtattttacccagaaaggtaaaaatctgaacgcaattacccgcaaatgggaagaaaccattagcattcagaatgtggcaaaaccgagtaaagttaccctgctgggttataaaggtgaagttaaatttacctacaagaacggtaccctgaccattatggccccgagcgtgaatccgagcaatattccgtgtcagtatgcctggacctatgaaattgaaaatgcactgggtacctggtctcatccgcagttcgagaaataa

SEQ ID NO: 148 - protein, 1445 aa, Artificial Sequence
  SYNTHETIC FUSION PROTEN
MGSSHHHHHHSSGLVPRGSHMTHHDSLNTVKAEEKTVQVQKGLPSIDSLHYLSENSKKEFKEELSKAGQESQKVKEILAKAQQADKQAQELAKMKIPEKIPMKPLHGSLYGGYFRTWHDKTSDPTEKDKVNSMGELPKEVDLAFIFHDWTKDYSLFWKELATKHVPKLNKQGTRVIRTIPWRFLAGGDNSGIAEDTSKYPNTPEGNKALAKAIVDEYVYKYNLDGLDVQVEHDSIPKVDKKEDTAGVERSIQVFEEIGKLIGPKGVDKSRLFIMDSTYMADKNPLIERGAPYINLLLVQVYGSQGEKGGWEPVSNRPEKTMEERWQGYSKYIRPEQYMIGFSFYEENAQEGNLWYDINSRKDEDKANGINTDITGTRAERYARWQPKTGGVKGGIFSYAIDRDGVAHQPKKYAKQKEFKDATDNIFHSDYSVSKALKTVMLKDKSYDLIDEKDFPDKALREAVMAQVGTRKGDLERFNGTLRLDNPAIQSLEGLNKFKKLAQLDLIGLSRITKLDRSVLPANMKPGKDTLETVLETYKKDNKEEPATIPPVSLKVSGLTGLKELDLSGFDRETLAGLDAATLTSLEKVDISGNKLDLAPGTENRQIFDTMLSTISNHVGSNEQTVKFDKQKPTGHYPDTYGKTSLRLPVANEKVDLQSQLLFGTVTNQGTLINSEADYKAYQNHKIAGRSFVDSNYHYNNFKVSYENYTVKVTDSTLGTTTDKTLATDKEETYKVDFFSPADKTKAVHTAKVIVGDEKTMMVNLAEGATVIGGSADPVNARKVFDGQLGSETDNISLGWDSKQSIIFKLKEDGLIKHWRFFNDSARNPETTNKPIQEASLQIFNIKDYNLDNLLENPNKFDDEKYWITVDTYSAQGERATAFSNTLNNITSKYWRVVFDTKGDRYSSPVVPELQILGYPLPNADTIMKTVTTAKELSQQKDKFSQKMLDELKIKEMALETSLNSKIFDVTAINANAGVLKDCIEKRQLLKKGSGAQYQANWQSLDQRPTPAWFEDAKFGIFIHWGLYSVPSWATKSNADGFGSGYSEWYWQRLFAKNLKIHPEFVEFHKKNFGDKNYQDFVQNFKAELFQPNDWANIFEQAGAKYVVLTSKHHEGFTLWPSKESWNWNSVDVGPHRDLAGDLMTAVRAKNLKMGYYYSLYEWFNPVYKADVNTYVSERMLPQMKDLVTRYKPDILWTDGEWDYPAKTWRSEEFLAWLFNESNVKNEIVVNDRWGSDTKSKHGSFATSEYGHGGTDNTETTGGFQRPWEECRGMGESFGYNRNENLDSYQTGEALVHQLIDIVAKGGNLLLNIGPAADGTIPVIMQERLHEIGSWLKVNGSAIYGTRRWSKAPAYTKESTLYFTQKGKNLNAITRKWEETISIQNVAKPSKVTLLGYKGEVKFTYKNGTLTIMAPSVNPSNIPCQYAWTYEIENALGTWSHPQFEK

SEQ ID NO: 149 - DNA, 3849 bp, Artificial Sequence
  SYNTHETIC FUSION PROTEN
atgggcagcagccatcatcatcatcatcacagcagcggcctggtgccgcgcggcagccatatggaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcagacaattggtgttaacgaattaaatggacgtacaggtttatctaaagattatcctgatactcctgaggggaacaaagctttagcagcagccattgtcaaggcatttgtaactgatcgtggtgtcgatggactagatattgatattgagcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggatggatccggtgctcagtatcaggcaaattggcagagtctggatcagcgcccgaccccggcatggtttgaagatgccaaatttggcatttttatccattggggcctgtatagtgtgccgagctgggcaaccaaaagtaatgccgatggctttggtagcggctatagtgaatggtattggcagcgtctgtttgcaaaaaatctgaaaattcatccggaatttgtggaatttcataaaaaaaacttcggcgataagaactatcaggattttgtgcagaattttaaggcagaactgtttcagccgaatgattgggcaaatatttttgaacaggcaggcgccaaatatgttgtgctgaccagtaaacatcatgaaggttttaccctgtggccgagcaaagaaagctggaattggaatagtgttgatgtgggcccgcatcgtgatctggcaggtgatctgatgaccgccgtgcgtgcaaaaaatttaaaaatgggttattactacagcctgtatgaatggtttaatccggtttataaagccgatgtgaatacctatgttagcgaacgtatgctgccgcagatgaaagatctggttacccgctataaaccggatattctgtggaccgatggcgaatgggattatccggcaaaaacctggcgtagcgaagaatttctggcatggctgtttaatgaaagtaatgttaaaaacgagatcgtggttaatgatcgttggggtagtgataccaaaagcaaacatggtagctttgccaccagtgaatatggccacggtggtaccgataataccgaaaccaccggtggctttcagcgtccgtgggaagaatgccgtggtatgggtgaaagttttggctataatcgtaatgaaaacctggatagctatcagaccggcgaagcactggtgcatcagctgattgatattgttgccaaaggcggtaatctgctgctgaatattggcccggcagccgatggcaccattccggttattatgcaggaacgcctgcatgaaattggcagctggctgaaagttaatggcagcgcaatttatggcacccgtcgctggagcaaagcaccggcatataccaaagaaagtaccctgtattttacccagaaaggtaaaaatctgaacgcaattacccgcaaatgggaagaaaccattagcattcagaatgtggcaaaaccgagtaaagttaccctgctgggttataaaggtgaagttaaatttacctacaagaacggtaccctgaccattatggccccgagcgtgaatccgagcaatattccgtgtcagtatgcctggacctatgaaattgaaaatgcactgagtacctggtctcatccgcagttcgagaaataa

SEQ ID NO: 150 - protein, 1282 aa, Artificial Sequence
  SYNTHETIC FUSION PROTEN
MGSSHHHHHHSSGLVPRGSHMEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQTIGVNELNGRTGLSKDYPDTPEGNKALAAAIVKAFVTDRGVDGLDIDIEHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKDGSGAQYQANWQSLDQRPTPAWFEDAKFGIFIHWGLYSVPSWATKSNADGFGSGYSEWYWQRLFAKNLKIHPEFVEFHKKNFGDKNYQDFVQNFKAELFQPNDWANIFEQAGAKYVVLTSKHHEGFTLWPSKESWNWNSVDVGPHRDLAGDLMTAVRAKNLKMGYYYSLYEWFNPVYKADVNTYVSERMLPQMKDLVTRYKPDILWTDGEWDYPAKTWRSEEFLAWLFNESNVKNEIVVNDRWGSDTKSKHGSFATSEYGHGGTDNTETTGGFQRPWEECRGMGESFGYNRNENLDSYQTGEALVHQLIDIVAKGGNLLLNIGPAADGTIPVIMQERLHEIGSWLKVNGSAIYGTRRWSKAPAYTKESTLYFTQKGKNLNAITRKWEETISIQNVAKPSKVTLLGYKGEVKFTYKNGTLTIMAPSVNPSNIPCQYAWTYEIENALSTWSHPQFEK

SEQ ID NO: 151 - DNA, 3849 bp, Artificial Sequence
  SYNTHETIC FUSION PROTEN
atgggcagcagccatcatcatcatcatcacagcagcggcctggtgccgcgcggcagccatatggaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcaggaaattggtgttaacgaattaaatggacgtacaggtttatctaaagattatcctgatactcctgaggggaacaaagctttagcagcagccattgtcaaggcatttgtaactgatcgtggtgtcgatggactagatattgatattgagcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggatggatccggtgctcagtatcaggcaaattggcagagtctggatcagcgcccgaccccggcatggtttgaagatgccaaatttggcatttttatccattggggcctgtatagtgtgccgagctgggcaaccaaaagtaatgccgatggctttggtagcggctatagtgaatggtattggcagcgtctgtttgcaaaaaatctgaaaattcatccggaatttgtggaatttcataaaaaaaacttcggcgataagaactatcaggattttgtgcagaattttaaggcagaactgtttcagccgaatgattgggcaaatatttttgaacaggcaggcgccaaatatgttgtgctgaccagtaaacatcatgaaggttttaccctgtggccgagcaaagaaagctggaattggaatagtgttgatgtgggcccgcatcgtgatctggcaggtgatctgatgaccgccgtgcgtgcaaaaaatttaaaaatgggttattactacagcctgtatgaatggtttaatccggtttataaagccgatgtgaatacctatgttagcgaacgtatgctgccgcagatgaaagatctggttacccgctataaaccggatattctgtggaccgatggcgaatgggattatccggcaaaaacctggcgtagcgaagaatttctggcatggctgtttaatgaaagtaatgttaaaaacgagatcgtggttaatgatcgttggggtagtgataccaaaagcaaacatggtagctttgccaccagtgaatatggccacggtggtaccgataataccgaaaccaccggtggctttcagcgtccgtgggaagaatgccgtggtatgggtgaaagttttggctataatcgtaatgaaaacctggatagctatcagaccggcgaagcactggtgcatcagctgattgatattgttgccaaaggcggtaatctgctgctgaatattggcccggcagccgatggcaccattccggttattatgcaggaacgcctgcatgaaattggcagctggctgaaagttaatggcagcgcaatttatggcacccgtcgctggagcaaagcaccggcatataccaaagaaagtaccctgtattttacccagaaaggtaaaaatctgaacgcaattacccgcaaatgggaagaaaccattagcattcagaatgtggcaaaaccgagtaaagttaccctgctgggttataaaggtgaagttaaatttacctacaagaacggtaccctgaccattatggccccgagcgtgaatccgagcaatattccgtgtcagtatgcctggacctatgaaattgaaaatgcactgagtacctggtctcatccgcagttcgagaaataa

SEQ ID NO: 152 - protein, 1282 aa, Artificial Sequence
  SYNTHETIC FUSION PROTEN
MGSSHHHHHHSSGLVPRGSHMEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQEIGVNELNGRTGLSKDYPDTPEGNKALAAAIVKAFVTDRGVDGLDIDIEHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKDGSGAQYQANWQSLDQRPTPAWFEDAKFGIFIHWGLYSVPSWATKSNADGFGSGYSEWYWQRLFAKNLKIHPEFVEFHKKNFGDKNYQDFVQNFKAELFQPNDWANIFEQAGAKYVVLTSKHHEGFTLWPSKESWNWNSVDVGPHRDLAGDLMTAVRAKNLKMGYYYSLYEWFNPVYKADVNTYVSERMLPQMKDLVTRYKPDILWTDGEWDYPAKTWRSEEFLAWLFNESNVKNEIVVNDRWGSDTKSKHGSFATSEYGHGGTDNTETTGGFQRPWEECRGMGESFGYNRNENLDSYQTGEALVHQLIDIVAKGGNLLLNIGPAADGTIPVIMQERLHEIGSWLKVNGSAIYGTRRWSKAPAYTKESTLYFTQKGKNLNAITRKWEETISIQNVAKPSKVTLLGYKGEVKFTYKNGTLTIMAPSVNPSNIPCQYAWTYEIENALSTWSHPQFEK

SEQ ID NO: 153 - DNA, 3849 bp, Artificial Sequence
  SYNTHETIC FUSION PROTEN
atgggcagcagccatcatcatcatcatcacagcagcggcctggtgccgcgcggcagccatatggaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcagatgattggtgttaacgaattaaatggacgtacaggtttatctaaagattatcctgatactcctgaggggaacaaagctttagcagcagccattgtcaaggcatttgtaactgatcgtggtgtcgatggactagatattgatattgagcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggatggatccggtgctcagtatcaggcaaattggcagagtctggatcagcgcccgaccccggcatggtttgaagatgccaaatttggcatttttatccattggggcctgtatagtgtgccgagctgggcaaccaaaagtaatgccgatggctttggtagcggctatagtgaatggtattggcagcgtctgtttgcaaaaaatctgaaaattcatccggaatttgtggaatttcataaaaaaaacttcggcgataagaactatcaggattttgtgcagaattttaaggcagaactgtttcagccgaatgattgggcaaatatttttgaacaggcaggcgccaaatatgttgtgctgaccagtaaacatcatgaaggttttaccctgtggccgagcaaagaaagctggaattggaatagtgttgatgtgggcccgcatcgtgatctggcaggtgatctgatgaccgccgtgcgtgcaaaaaatttaaaaatgggttattactacagcctgtatgaatggtttaatccggtttataaagccgatgtgaatacctatgttagcgaacgtatgctgccgcagatgaaagatctggttacccgctataaaccggatattctgtggaccgatggcgaatgggattatccggcaaaaacctggcgtagcgaagaatttctggcatggctgtttaatgaaagtaatgttaaaaacgagatcgtggttaatgatcgttggggtagtgataccaaaagcaaacatggtagctttgccaccagtgaatatggccacggtggtaccgataataccgaaaccaccggtggctttcagcgtccgtgggaagaatgccgtggtatgggtgaaagttttggctataatcgtaatgaaaacctggatagctatcagaccggcgaagcactggtgcatcagctgattgatattgttgccaaaggcggtaatctgctgctgaatattggcccggcagccgatggcaccattccggttattatgcaggaacgcctgcatgaaattggcagctggctgaaagttaatggcagcgcaatttatggcacccgtcgctggagcaaagcaccggcatataccaaagaaagtaccctgtattttacccagaaaggtaaaaatctgaacgcaattacccgcaaatgggaagaaaccattagcattcagaatgtggcaaaaccgagtaaagttaccctgctgggttataaaggtgaagttaaatttacctacaagaacggtaccctgaccattatggccccgagcgtgaatccgagcaatattccgtgtcagtatgcctggacctatgaaattgaaaatgcactgagtacctggtctcatccgcagttcgagaaataa

SEQ ID NO: 154 - protein, 1282 aa, Artificial Sequence
  SYNTHETIC FUSION PROTEN
MGSSHHHHHHSSGLVPRGSHMEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQMIGVNELNGRTGLSKDYPDTPEGNKALAAAIVKAFVTDRGVDGLDIDIEHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKDGSGAQYQANWQSLDQRPTPAWFEDAKFGIFIHWGLYSVPSWATKSNADGFGSGYSEWYWQRLFAKNLKIHPEFVEFHKKNFGDKNYQDFVQNFKAELFQPNDWANIFEQAGAKYVVLTSKHHEGFTLWPSKESWNWNSVDVGPHRDLAGDLMTAVRAKNLKMGYYYSLYEWFNPVYKADVNTYVSERMLPQMKDLVTRYKPDILWTDGEWDYPAKTWRSEEFLAWLFNESNVKNEIVVNDRWGSDTKSKHGSFATSEYGHGGTDNTETTGGFQRPWEECRGMGESFGYNRNENLDSYQTGEALVHQLIDIVAKGGNLLLNIGPAADGTIPVIMQERLHEIGSWLKVNGSAIYGTRRWSKAPAYTKESTLYFTQKGKNLNAITRKWEETISIQNVAKPSKVTLLGYKGEVKFTYKNGTLTIMAPSVNPSNIPCQYAWTYEIENALSTWSHPQFEK

SEQ ID NO: 155 - DNA, 3849 bp, Artificial Sequence
  SYNTHETIC FUSION PROTEN
atgggcagcagccatcatcatcatcatcacagcagcggcctggtgccgcgcggcagccatatggaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcagacaattggtgttaacgaattaaatggacgtacaggtttatctaaagattatcctgatactcctgaggggaacaaagctttagcagcagccattgtcaaggcatttgtaactgatcgtggtgtcgatggactagatattatgattgagcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggatggatccggtgctcagtatcaggcaaattggcagagtctggatcagcgcccgaccccggcatggtttgaagatgccaaatttggcatttttatccattggggcctgtatagtgtgccgagctgggcaaccaaaagtaatgccgatggctttggtagcggctatagtgaatggtattggcagcgtctgtttgcaaaaaatctgaaaattcatccggaatttgtggaatttcataaaaaaaacttcggcgataagaactatcaggattttgtgcagaattttaaggcagaactgtttcagccgaatgattgggcaaatatttttgaacaggcaggcgccaaatatgttgtgctgaccagtaaacatcatgaaggttttaccctgtggccgagcaaagaaagctggaattggaatagtgttgatgtgggcccgcatcgtgatctggcaggtgatctgatgaccgccgtgcgtgcaaaaaatttaaaaatgggttattactacagcctgtatgaatggtttaatccggtttataaagccgatgtgaatacctatgttagcgaacgtatgctgccgcagatgaaagatctggttacccgctataaaccggatattctgtggaccgatggcgaatgggattatccggcaaaaacctggcgtagcgaagaatttctggcatggctgtttaatgaaagtaatgttaaaaacgagatcgtggttaatgatcgttggggtagtgataccaaaagcaaacatggtagctttgccaccagtgaatatggccacggtggtaccgataataccgaaaccaccggtggctttcagcgtccgtgggaagaatgccgtggtatgggtgaaagttttggctataatcgtaatgaaaacctggatagctatcagaccggcgaagcactggtgcatcagctgattgatattgttgccaaaggcggtaatctgctgctgaatattggcccggcagccgatggcaccattccggttattatgcaggaacgcctgcatgaaattggcagctggctgaaagttaatggcagcgcaatttatggcacccgtcgctggagcaaagcaccggcatataccaaagaaagtaccctgtattttacccagaaaggtaaaaatctgaacgcaattacccgcaaatgggaagaaaccattagcattcagaatgtggcaaaaccgagtaaagttaccctgctgggttataaaggtgaagttaaatttacctacaagaacggtaccctgaccattatggccccgagcgtgaatccgagcaatattccgtgtcagtatgcctggacctatgaaattgaaaatgcactgagtacctggtctcatccgcagttcgagaaataa

SEQ ID NO: 156 - protein, 1282 aa, Artificial Sequence
  SYNTHETIC FUSION PROTEN
MGSSHHHHHHSSGLVPRGSHMEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQTIGVNELNGRTGLSKDYPDTPEGNKALAAAIVKAFVTDRGVDGLDIMIEHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKDGSGAQYQANWQSLDQRPTPAWFEDAKFGIFIHWGLYSVPSWATKSNADGFGSGYSEWYWQRLFAKNLKIHPEFVEFHKKNFGDKNYQDFVQNFKAELFQPNDWANIFEQAGAKYVVLTSKHHEGFTLWPSKESWNWNSVDVGPHRDLAGDLMTAVRAKNLKMGYYYSLYEWFNPVYKADVNTYVSERMLPQMKDLVTRYKPDILWTDGEWDYPAKTWRSEEFLAWLFNESNVKNEIVVNDRWGSDTKSKHGSFATSEYGHGGTDNTETTGGFQRPWEECRGMGESFGYNRNENLDSYQTGEALVHQLIDIVAKGGNLLLNIGPAADGTIPVIMQERLHEIGSWLKVNGSAIYGTRRWSKAPAYTKESTLYFTQKGKNLNAITRKWEETISIQNVAKPSKVTLLGYKGEVKFTYKNGTLTIMAPSVNPSNIPCQYAWTYEIENALSTWSHPQFEK

SEQ ID NO: 157 - DNA, 3042 bp, Artificial Sequence
  SYNTHETIC FUSION PROTEN
atgggcagcagccatcatcatcatcatcacagcagcggcctggtgccgcgcggcagccatatgcagtatcaggcaaattggcagagtctggatcagcgcccgaccccggcatggtttgaagatgccaaatttggcatttttatccattggggcctgtatagtgtgccgagctgggcaaccaaaagtaatgccgatggctttggtagcggctatagtgaatggtattggcagcgtctgtttgcaaaaaatctgaaaattcatccggaatttgtggaatttcataaaaaaaacttcggcgataagaactatcaggattttgtgcagaattttaaggcagaactgtttcagccgaatgattgggcaaatatttttgaacaggcaggcgccaaatatgttgtgctgaccagtaaacatcatgaaggttttaccctgtggccgagcaaagaaagctggaattggaatagtgttgatgtgggcccgcatcgtgatctggcaggtgatctgatgaccgccgtgcgtgcaaaaaatttaaaaatgggttattactacagcctgtatgaatggtttaatccggtttataaagccgatgtgaatacctatgttagcgaacgtatgctgccgcagatgaaagatctggttacccgctataaaccggatattctgtggaccgatggcgaatgggattatccggcaaaaacctggcgtagcgaagaatttctggcatggctgtttaatgaaagtaatgttaaaaacgagatcgtggttaatgatcgttggggtagtgataccaaaagcaaacatggtagctttgccaccagtgaatatggccacggtggtaccgataataccgaaaccaccggtggctttcagcgtccgtgggaagaatgccgtggtatgggtgaaagttttggctataatcgtaatgaaaacctggatagctatcagaccggcgaagcactggtgcatcagctgattgatattgttgccaaaggcggtaatctgctgctgaatattggcccggcagccgatggcaccattccggttattatgcaggaacgcctgcatgaaattggcagctggctgaaagttaatggcagcgcaatttatggcacccgtcgctggagcaaagcaccggcatataccaaagaaagtaccctgtattttacccagaaaggtaaaaatctgaacgcaattacccgcaaatgggaagaaaccattagcattcagaatgtggcaaaaccgagtaaagttaccctgctgggttataaaggtgaagttaaatttacctacaagaacggtaccctgaccattatggccccgagcgtgaatccgagcaatattccgtgtcagtatgcctggacctatgaaattgaaaatgcactgggatccaaagataagtcgtatgatctgattgatgagaaagatttcccagataaggctttgcgagaagctgtgatggcgcaggttggaaccagaaaaggtgatttggaacgtttcaatggcacattacgattggataatccagcgattcaaagtttagaaggtctaaataaatttaaaaaattagctcaattagacttgattggcttatctcgcattacaaagctcgaccgttctgttttacccgctaatatgaagccaggcaaagataccttggaaacagttcttgaaacctataaaaaggataacaaagaagaacctgctactatcccaccagtatctttgaaggtttctggtttaactggtctgaaagaattagatttgtcaggttttgaccgtgaaaccttggctggtcttgatgccgctactctaacgtctttagaaaaagttgatatttctggcaacaaacttgatttggctccaggaacagaaaatcgacaaatttttgatactatgctatcaactatcagcaatcatgttggaagcaatgaacaaacagtgaaatttgacaagcaaaaaccaactgggcattacccagatacctatgggaaaactagtctgcgcttaccagtggcaaatgaaaaagttgatttgcaaagccagcttttgtttgggactgtgacaaatcaaggaaccctaatcaatagcgaagcagactataaggcttaccaaaatcataaaattgctggacgtagctttgttgattcaaactatcattacaataactttaaagtttcttatgagaactataccgttaaagtaactgattccacattgggaaccactactgacaaaacgctagcaactgataaagaagagacctataaggttgacttctttagcccagcagataagacaaaagctgttcatactgctaaagtgattgttggtgacgaaaaaaccatgatggttaatttggcagaaggcgcaacagttattggaggaagtgctgatcctgtaaatgcaagaaaggtatttgatgggcaactgggcagtgagactgataatatctctttaggatgggattctaagcaaagtattatatttaaattgaaagaagatggattaataaagcattggcgtttcttcaatgattcagcccgaaatcctgagacaaccaataaacctattcaggaagcaagtctacaaatttttaatatcaaagattataatctagataatttgttggaaaatcccaataaatttgatgatgaaaaatattggattactgtagatacttacagtgcacaaggagagagagctactgcattcagtaatacattaaataatattactagtaaatattggcgagttgtctttgatactaaaggagatagatatagttcgccagtagtccctgaactccaaattttaggttatccgttacctaacgccgacactatcatgaaaacagtaactactgctaaagagttatctcaacaaaaagataagttttctcaaaagatgcttgatgagttaaaaataaaagagatggctttagaaacttctttgaacagtaagatttttgatgtaactgctattaatgctaatgctggagttttgaaagattgtattgagaaaaggcagctgctaaaaaaataa

SEQ ID NO: 158 - protein, 1013 aa, Artificial Sequence
  SYNTHETIC FUSION PROTEN
MGSSHHHHHHSSGLVPRGSHMQYQANWQSLDQRPTPAWFEDAKFGIFIHWGLYSVPSWATKSNADGFGSGYSEWYWQRLFAKNLKIHPEFVEFHKKNFGDKNYQDFVQNFKAELFQPNDWANIFEQAGAKYVVLTSKHHEGFTLWPSKESWNWNSVDVGPHRDLAGDLMTAVRAKNLKMGYYYSLYEWFNPVYKADVNTYVSERMLPQMKDLVTRYKPDILWTDGEWDYPAKTWRSEEFLAWLFNESNVKNEIVVNDRWGSDTKSKHGSFATSEYGHGGTDNTETTGGFQRPWEECRGMGESFGYNRNENLDSYQTGEALVHQLIDIVAKGGNLLLNIGPAADGTIPVIMQERLHEIGSWLKVNGSAIYGTRRWSKAPAYTKESTLYFTQKGKNLNAITRKWEETISIQNVAKPSKVTLLGYKGEVKFTYKNGTLTIMAPSVNPSNIPCQYAWTYEIENALGSKDKSYDLIDEKDFPDKALREAVMAQVGTRKGDLERFNGTLRLDNPAIQSLEGLNKFKKLAQLDLIGLSRITKLDRSVLPANMKPGKDTLETVLETYKKDNKEEPATIPPVSLKVSGLTGLKELDLSGFDRETLAGLDAATLTSLEKVDISGNKLDLAPGTENRQIFDTMLSTISNHVGSNEQTVKFDKQKPTGHYPDTYGKTSLRLPVANEKVDLQSQLLFGTVTNQGTLINSEADYKAYQNHKIAGRSFVDSNYHYNNFKVSYENYTVKVTDSTLGTTTDKTLATDKEETYKVDFFSPADKTKAVHTAKVIVGDEKTMMVNLAEGATVIGGSADPVNARKVFDGQLGSETDNISLGWDSKQSIIFKLKEDGLIKHWRFFNDSARNPETTNKPIQEASLQIFNIKDYNLDNLLENPNKFDDEKYWITVDTYSAQGERATAFSNTLNNITSKYWRVVFDTKGDRYSSPVVPELQILGYPLPNADTIMKTVTTAKELSQQKDKFSQKMLDELKIKEMALETSLNSKIFDVTAINANAGVLKDCIEKRQLLKK

SEQ ID NO: 159 - DNA, 2769 bp, Artificial Sequence
  SYNTHETIC FUSION PROTEN
atgggcagcagccatcatcatcatcatcacagcagcggcctggtgccgcgcggcagccatatgcagtatcaggcaaattggcagagtctggatcagcgcccgaccccggcatggtttgaagatgccaaatttggcatttttatccattggggcctgtatagtgtgccgagctgggcaaccaaaagtaatgccgatggctttggtagcggctatagtgaatggtattggcagcgtctgtttgcaaaaaatctgaaaattcatccggaatttgtggaatttcataaaaaaaacttcggcgataagaactatcaggattttgtgcagaattttaaggcagaactgtttcagccgaatgattgggcaaatatttttgaacaggcaggcgccaaatatgttgtgctgaccagtaaacatcatgaaggttttaccctgtggccgagcaaagaaagctggaattggaatagtgttgatgtgggcccgcatcgtgatctggcaggtgatctgatgaccgccgtgcgtgcaaaaaatttaaaaatgggttattactacagcctgtatgaatggtttaatccggtttataaagccgatgtgaatacctatgttagcgaacgtatgctgccgcagatgaaagatctggttacccgctataaaccggatattctgtggaccgatggcgaatgggattatccggcaaaaacctggcgtagcgaagaatttctggcatggctgtttaatgaaagtaatgttaaaaacgagatcgtggttaatgatcgttggggtagtgataccaaaagcaaacatggtagctttgccaccagtgaatatggccacggtggtaccgataataccgaaaccaccggtggctttcagcgtccgtgggaagaatgccgtggtatgggtgaaagttttggctataatcgtaatgaaaacctggatagctatcagaccggcgaagcactggtgcatcagctgattgatattgttgccaaaggcggtaatctgctgctgaatattggcccggcagccgatggcaccattccggttattatgcaggaacgcctgcatgaaattggcagctggctgaaagttaatggcagcgcaatttatggcacccgtcgctggagcaaagcaccggcatataccaaagaaagtaccctgtattttacccagaaaggtaaaaatctgaacgcaattacccgcaaatgggaagaaaccattagcattcagaatgtggcaaaaccgagtaaagttaccctgctgggttataaaggtgaagttaaatttacctacaagaacggtaccctgaccattatggccccgagcgtgaatccgagcaatattccgtgtcagtatgcctggacctatgaaattgaaaatgcactgggatccaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggattaa

SEQ ID NO: 160 - protein, 922 aa, Artificial Sequence
  SYNTHETIC FUSION PROTEN
MGSSHHHHHHSSGLVPRGSHMQYQANWQSLDQRPTPAWFEDAKFGIFIHWGLYSVPSWATKSNADGFGSGYSEWYWQRLFAKNLKIHPEFVEFHKKNFGDKNYQDFVQNFKAELFQPNDWANIFEQAGAKYVVLTSKHHEGFTLWPSKESWNWNSVDVGPHRDLAGDLMTAVRAKNLKMGYYYSLYEWFNPVYKADVNTYVSERMLPQMKDLVTRYKPDILWTDGEWDYPAKTWRSEEFLAWLFNESNVKNEIVVNDRWGSDTKSKHGSFATSEYGHGGTDNTETTGGFQRPWEECRGMGESFGYNRNENLDSYQTGEALVHQLIDIVAKGGNLLLNIGPAADGTIPVIMQERLHEIGSWLKVNGSAIYGTRRWSKAPAYTKESTLYFTQKGKNLNAITRKWEETISIQNVAKPSKVTLLGYKGEVKFTYKNGTLTIMAPSVNPSNIPCQYAWTYEIENALGSTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKD

SEQ ID NO: 161 - DNA, 4302 bp, Artificial Sequence
  SYNTHETIC FUSION PROTEN
atgggcagcagccatcatcatcatcatcacagcagcggcctggtgccgcgcggcagccatatgcagtatcaggcaaattggcagagtctggatcagcgcccgaccccggcatggtttgaagatgccaaatttggcatttttatccattggggcctgtatagtgtgccgagctgggcaaccaaaagtaatgccgatggctttggtagcggctatagtgaatggtattggcagcgtctgtttgcaaaaaatctgaaaattcatccggaatttgtggaatttcataaaaaaaacttcggcgataagaactatcaggattttgtgcagaattttaaggcagaactgtttcagccgaatgattgggcaaatatttttgaacaggcaggcgccaaatatgttgtgctgaccagtaaacatcatgaaggttttaccctgtggccgagcaaagaaagctggaattggaatagtgttgatgtgggcccgcatcgtgatctggcaggtgatctgatgaccgccgtgcgtgcaaaaaatttaaaaatgggttattactacagcctgtatgaatggtttaatccggtttataaagccgatgtgaatacctatgttagcgaacgtatgctgccgcagatgaaagatctggttacccgctataaaccggatattctgtggaccgatggcgaatgggattatccggcaaaaacctggcgtagcgaagaatttctggcatggctgtttaatgaaagtaatgttaaaaacgagatcgtggttaatgatcgttggggtagtgataccaaaagcaaacatggtagctttgccaccagtgaatatggccacggtggtaccgataataccgaaaccaccggtggctttcagcgtccgtgggaagaatgccgtggtatgggtgaaagttttggctataatcgtaatgaaaacctggatagctatcagaccggcgaagcactggtgcatcagctgattgatattgttgccaaaggcggtaatctgctgctgaatattggcccggcagccgatggcaccattccggttattatgcaggaacgcctgcatgaaattggcagctggctgaaagttaatggcagcgcaatttatggcacccgtcgctggagcaaagcaccggcatataccaaagaaagtaccctgtattttacccagaaaggtaaaaatctgaacgcaattacccgcaaatgggaagaaaccattagcattcagaatgtggcaaaaccgagtaaagttaccctgctgggttataaaggtgaagttaaatttacctacaagaacggtaccctgaccattatggccccgagcgtgaatccgagcaatattccgtgtcagtatgcctggacctatgaaattgaaaatgcactgggatccacccaccatgattcactcaatactgtaaaagcggaggagaagactgttcaggttcagaaaggattaccttctatcgatagcttgcattatctgtcagagaatagcaaaaaagaatttaaagaagaactctcaaaagcggggcaagaatctcaaaaggtcaaagagatattagcaaaagctcagcaggcagataaacaagctcaagaacttgccaaaatgaaaattcctgagaaaataccgatgaaaccgttacatggttctctctacggtggttactttagaacttggcatgacaaaacatcagatccaacagaaaaagacaaagttaactcgatgggagagcttcctaaagaagtagatctagcctttattttccacgattggacaaaagattatagccttttttggaaagaattggccaccaaacatgtgccaaagttaaacaagcaagggacacgtgtcattcgtaccattccatggcgtttcctagctgggggtgataacagtggtattgcagaagataccagtaaatacccaaatacaccagagggaaataaagctttagccaaagctattgttgatgaatatgtttataaatacaaccttgatggcttagatgtggatgttgaacatgatagtattccaaaagttgacaaaaaagaagatacagcaggcgtagaacgctctattcaagtgtttgaagaaattgggaaattaattggaccaaaaggtgttgataaatcgcggttatttattatggatagcacctacatggctgataaaaacccattgattgagcgaggagctccttatattaatttattactggtacaggtctatggttcacaaggagagaaaggtggttgggagcctgtttctaatcgacctgaaaaaacaatggaagaacgatggcaaggttatagcaagtatattcgtcctgaacaatacatgattggtttttctttctatgaggaaaatgctcaagaagggaatctttggtatgatattaattctcgcaaggacgaggacaaagcaaatggaattaacactgacataactggaacgcgtgccgaacggtatgcaaggtggcaacctaagacaggtggggttaagggaggtatcttctcctacgctattgaccgagatggtgtagctcatcaacctaaaaaatatgctaaacagaaagagtttaaggacgcaactgataacatcttccactcagattatagtgtctccaaggcattaaagacagttatgctaaaagataagtcgtatgatctgattgatgagaaagatttcccagataaggctttgcgagaagctgtgatggcgcaggttggaaccagaaaaggtgatttggaacgtttcaatggcacattacgattggataatccagcgattcaaagtttagaaggtctaaataaatttaaaaaattagctcaattagacttgattggcttatctcgcattacaaagctcgaccgttctgttttacccgctaatatgaagccaggcaaagataccttggaaacagttcttgaaacctataaaaaggataacaaagaagaacctgctactatcccaccagtatctttgaaggtttctggtttaactggtctgaaagaattagatttgtcaggttttgaccgtgaaaccttggctggtcttgatgccgctactctaacgtctttagaaaaagttgatatttctggcaacaaacttgatttggctccaggaacagaaaatcgacaaatttttgatactatgctatcaactatcagcaatcatgttggaagcaatgaacaaacagtgaaatttgacaagcaaaaaccaactgggcattacccagatacctatgggaaaactagtctgcgcttaccagtggcaaatgaaaaagttgatttgcaaagccagcttttgtttgggactgtgacaaatcaaggaaccctaatcaatagcgaagcagactataaggcttaccaaaatcataaaattgctggacgtagctttgttgattcaaactatcattacaataactttaaagtttcttatgagaactataccgttaaagtaactgattccacattgggaaccactactgacaaaacgctagcaactgataaagaagagacctataaggttgacttctttagcccagcagataagacaaaagctgttcatactgctaaagtgattgttggtgacgaaaaaaccatgatggttaatttggcagaaggcgcaacagttattggaggaagtgctgatcctgtaaatgcaagaaaggtatttgatgggcaactgggcagtgagactgataatatctctttaggatgggattctaagcaaagtattatatttaaattgaaagaagatggattaataaagcattggcgtttcttcaatgattcagcccgaaatcctgagacaaccaataaacctattcaggaagcaagtctacaaatttttaatatcaaagattataatctagataatttgttggaaaatcccaataaatttgatgatgaaaaatattggattactgtagatacttacagtgcacaaggagagagagctactgcattcagtaatacattaaataatattactagtaaatattggcgagttgtctttgatactaaaggagatagatatagttcgccagtagtccctgaactccaaattttaggttatccgttacctaacgccgacactatcatgaaaacagtaactactgctaaagagttatctcaacaaaaagataagttttctcaaaagatgcttgatgagttaaaaataaaagagatggctttagaaacttctttgaacagtaagatttttgatgtaactgctattaatgctaatgctggagttttgaaagattgtattgagaaaaggcagctgctaaaaaaataa

SEQ ID NO: 162 - protein, 1433 aa, Artificial Sequence
  SYNTHETIC FUSION PROTEN
MGSSHHHHHHSSGLVPRGSHMQYQANWQSLDQRPTPAWFEDAKFGIFIHWGLYSVPSWATKSNADGFGSGYSEWYWQRLFAKNLKIHPEFVEFHKKNFGDKNYQDFVQNFKAELFQPNDWANIFEQAGAKYVVLTSKHHEGFTLWPSKESWNWNSVDVGPHRDLAGDLMTAVRAKNLKMGYYYSLYEWFNPVYKADVNTYVSERMLPQMKDLVTRYKPDILWTDGEWDYPAKTWRSEEFLAWLFNESNVKNEIVVNDRWGSDTKSKHGSFATSEYGHGGTDNTETTGGFQRPWEECRGMGESFGYNRNENLDSYQTGEALVHQLIDIVAKGGNLLLNIGPAADGTIPVIMQERLHEIGSWLKVNGSAIYGTRRWSKAPAYTKESTLYFTQKGKNLNAITRKWEETISIQNVAKPSKVTLLGYKGEVKFTYKNGTLTIMAPSVNPSNIPCQYAWTYEIENALGSTHHDSLNTVKAEEKTVQVQKGLPSIDSLHYLSENSKKEFKEELSKAGQESQKVKEILAKAQQADKQAQELAKMKIPEKIPMKPLHGSLYGGYFRTWHDKTSDPTEKDKVNSMGELPKEVDLAFIFHDWTKDYSLFWKELATKHVPKLNKQGTRVIRTIPWRFLAGGDNSGIAEDTSKYPNTPEGNKALAKAIVDEYVYKYNLDGLDVDVEHDSIPKVDKKEDTAGVERSIQVFEEIGKLIGPKGVDKSRLFIMDSTYMADKNPLIERGAPYINLLLVQVYGSQGEKGGWEPVSNRPEKTMEERWQGYSKYIRPEQYMIGFSFYEENAQEGNLWYDINSRKDEDKANGINTDITGTRAERYARWQPKTGGVKGGIFSYAIDRDGVAHQPKKYAKQKEFKDATDNIFHSDYSVSKALKTVMLKDKSYDLIDEKDFPDKALREAVMAQVGTRKGDLERFNGTLRLDNPAIQSLEGLNKFKKLAQLDLIGLSRITKLDRSVLPANMKPGKDTLETVLETYKKDNKEEPATIPPVSLKVSGLTGLKELDLSGFDRETLAGLDAATLTSLEKVDISGNKLDLAPGTENRQIFDTMLSTISNHVGSNEQTVKFDKQKPTGHYPDTYGKTSLRLPVANEKVDLQSQLLFGTVTNQGTLINSEADYKAYQNHKIAGRSFVDSNYHYNNFKVSYENYTVKVTDSTLGTTTDKTLATDKEETYKVDFFSPADKTKAVHTAKVIVGDEKTMMVNLAEGATVIGGSADPVNARKVFDGQLGSETDNISLGWDSKQSIIFKLKEDGLIKHWRFFNDSARNPETTNKPIQEASLQIFNIKDYNLDNLLENPNKFDDEKYWITVDTYSAQGERATAFSNTLNNITSKYWRVVFDTKGDRYSSPVVPELQILGYPLPNADTIMKTVTTAKELSQQKDKFSQKMLDELKIKEMALETSLNSKIFDVTAINANAGVLKDCIEKRQLLKK

SEQ ID NO: 163 - DNA, 4302 bp, Artificial Sequence
  SYNTHETIC FUSION PROTEN
atgggcagcagccatcatcatcatcatcacagcagcggcctggtgccgcgcggcagccatatgcagtatcaggcaaattggcagagtctggatcagcgcccgaccccggcatggtttgaagatgccaaatttggcatttttatccattggggcctgtatagtgtgccgagctgggcaaccaaaagtaatgccgatggctttggtagcggctatagtgaatggtattggcagcgtctgtttgcaaaaaatctgaaaattcatccggaatttgtggaatttcataaaaaaaacttcggcgataagaactatcaggattttgtgcagaattttaaggcagaactgtttcagccgaatgattgggcaaatatttttgaacaggcaggcgccaaatatgttgtgctgaccagtaaacatcatgaaggttttaccctgtggccgagcaaagaaagctggaattggaatagtgttgatgtgggcccgcatcgtgatctggcaggtgatctgatgaccgccgtgcgtgcaaaaaatttaaaaatgggttattactacagcctgtatgaatggtttaatccggtttataaagccgatgtgaatacctatgttagcgaacgtatgctgccgcagatgaaagatctggttacccgctataaaccggatattctgtggaccgatggcgaatgggattatccggcaaaaacctggcgtagcgaagaatttctggcatggctgtttaatgaaagtaatgttaaaaacgagatcgtggttaatgatcgttggggtagtgataccaaaagcaaacatggtagctttgccaccagtgaatatggccacggtggtaccgataataccgaaaccaccggtggctttcagcgtccgtgggaagaatgccgtggtatgggtgaaagttttggctataatcgtaatgaaaacctggatagctatcagaccggcgaagcactggtgcatcagctgattgatattgttgccaaaggcggtaatctgctgctgaatattggcccggcagccgatggcaccattccggttattatgcaggaacgcctgcatgaaattggcagctggctgaaagttaatggcagcgcaatttatggcacccgtcgctggagcaaagcaccggcatataccaaagaaagtaccctgtattttacccagaaaggtaaaaatctgaacgcaattacccgcaaatgggaagaaaccattagcattcagaatgtggcaaaaccgagtaaagttaccctgctgggttataaaggtgaagttaaatttacctacaagaacggtaccctgaccattatggccccgagcgtgaatccgagcaatattccgtgtcagtatgcctggacctatgaaattgaaaatgcactgggatccacccaccatgattcactcaatactgtaaaagcggaggagaagactgttcaggttcagaaaggattaccttctatcgatagcttgcattatctgtcagagaatagcaaaaaagaatttaaagaagaactctcaaaagcggggcaagaatctcaaaaggtcaaagagatattagcaaaagctcagcaggcagataaacaagctcaagaacttgccaaaatgaaaattcctgagaaaataccgatgaaaccgttacatggttctctctacggtggttactttagaacttggcatgacaaaacatcagatccaacagaaaaagacaaagttaactcgatgggagagcttcctaaagaagtagatctagcctttattttccacgattggacaaaagattatagccttttttggaaagaattggccaccaaacatgtgccaaagttaaacaagcaagggacacgtgtcattcgtaccattccatggcgtttcctagctgggggtgataacagtggtattgcagaagataccagtaaatacccaaatacaccagagggaaataaagctttagccaaagctattgttgatgaatatgtttataaatacaaccttgatggcttagatgtgcaggttgaacatgatagtattccaaaagttgacaaaaaagaagatacagcaggcgtagaacgctctattcaagtgtttgaagaaattgggaaattaattggaccaaaaggtgttgataaatcgcggttatttattatggatagcacctacatggctgataaaaacccattgattgagcgaggagctccttatattaatttattactggtacaggtctatggttcacaaggagagaaaggtggttgggagcctgtttctaatcgacctgaaaaaacaatggaagaacgatggcaaggttatagcaagtatattcgtcctgaacaatacatgattggtttttctttctatgaggaaaatgctcaagaagggaatctttggtatgatattaattctcgcaaggacgaggacaaagcaaatggaattaacactgacataactggaacgcgtgccgaacggtatgcaaggtggcaacctaagacaggtggggttaagggaggtatcttctcctacgctattgaccgagatggtgtagctcatcaacctaaaaaatatgctaaacagaaagagtttaaggacgcaactgataacatcttccactcagattatagtgtctccaaggcattaaagacagttatgctaaaagataagtcgtatgatctgattgatgagaaagatttcccagataaggctttgcgagaagctgtgatggcgcaggttggaaccagaaaaggtgatttggaacgtttcaatggcacattacgattggataatccagcgattcaaagtttagaaggtctaaataaatttaaaaaattagctcaattagacttgattggcttatctcgcattacaaagctcgaccgttctgttttacccgctaatatgaagccaggcaaagataccttggaaacagttcttgaaacctataaaaaggataacaaagaagaacctgctactatcccaccagtatctttgaaggtttctggtttaactggtctgaaagaattagatttgtcaggttttgaccgtgaaaccttggctggtcttgatgccgctactctaacgtctttagaaaaagttgatatttctggcaacaaacttgatttggctccaggaacagaaaatcgacaaatttttgatactatgctatcaactatcagcaatcatgttggaagcaatgaacaaacagtgaaatttgacaagcaaaaaccaactgggcattacccagatacctatgggaaaactagtctgcgcttaccagtggcaaatgaaaaagttgatttgcaaagccagcttttgtttgggactgtgacaaatcaaggaaccctaatcaatagcgaagcagactataaggcttaccaaaatcataaaattgctggacgtagctttgttgattcaaactatcattacaataactttaaagtttcttatgagaactataccgttaaagtaactgattccacattgggaaccactactgacaaaacgctagcaactgataaagaagagacctataaggttgacttctttagcccagcagataagacaaaagctgttcatactgctaaagtgattgttggtgacgaaaaaaccatgatggttaatttggcagaaggcgcaacagttattggaggaagtgctgatcctgtaaatgcaagaaaggtatttgatgggcaactgggcagtgagactgataatatctctttaggatgggattctaagcaaagtattatatttaaattgaaagaagatggattaataaagcattggcgtttcttcaatgattcagcccgaaatcctgagacaaccaataaacctattcaggaagcaagtctacaaatttttaatatcaaagattataatctagataatttgttggaaaatcccaataaatttgatgatgaaaaatattggattactgtagatacttacagtgcacaaggagagagagctactgcattcagtaatacattaaataatattactagtaaatattggcgagttgtctttgatactaaaggagatagatatagttcgccagtagtccctgaactccaaattttaggttatccgttacctaacgccgacactatcatgaaaacagtaactactgctaaagagttatctcaacaaaaagataagttttctcaaaagatgcttgatgagttaaaaataaaagagatggctttagaaacttctttgaacagtaagatttttgatgtaactgctattaatgctaatgctggagttttgaaagattgtattgagaaaaggcagctgctaaaaaaataa

SEQ ID NO: 164 - protein, 1433 aa, Artificial Sequence
  SYNTHETIC FUSION PROTEN
MGSSHHHHHHSSGLVPRGSHMQYQANWQSLDQRPTPAWFEDAKFGIFIHWGLYSVPSWATKSNADGFGSGYSEWYWQRLFAKNLKIHPEFVEFHKKNFGDKNYQDFVQNFKAELFQPNDWANIFEQAGAKYVVLTSKHHEGFTLWPSKESWNWNSVDVGPHRDLAGDLMTAVRAKNLKMGYYYSLYEWFNPVYKADVNTYVSERMLPQMKDLVTRYKPDILWTDGEWDYPAKTWRSEEFLAWLFNESNVKNEIVVNDRWGSDTKSKHGSFATSEYGHGGTDNTETTGGFQRPWEECRGMGESFGYNRNENLDSYQTGEALVHQLIDIVAKGGNLLLNIGPAADGTIPVIMQERLHEIGSWLKVNGSAIYGTRRWSKAPAYTKESTLYFTQKGKNLNAITRKWEETISIQNVAKPSKVTLLGYKGEVKFTYKNGTLTIMAPSVNPSNIPCQYAWTYEIENALGSTHHDSLNTVKAEEKTVQVQKGLPSIDSLHYLSENSKKEFKEELSKAGQESQKVKEILAKAQQADKQAQELAKMKIPEKIPMKPLHGSLYGGYFRTWHDKTSDPTEKDKVNSMGELPKEVDLAFIFHDWTKDYSLFWKELATKHVPKLNKQGTRVIRTIPWRFLAGGDNSGIAEDTSKYPNTPEGNKALAKAIVDEYVYKYNLDGLDVQVEHDSIPKVDKKEDTAGVERSIQVFEEIGKLIGPKGVDKSRLFIMDSTYMADKNPLIERGAPYINLLLVQVYGSQGEKGGWEPVSNRPEKTMEERWQGYSKYIRPEQYMIGFSFYEENAQEGNLWYDINSRKDEDKANGINTDITGTRAERYARWQPKTGGVKGGIFSYAIDRDGVAHQPKKYAKQKEFKDATDNIFHSDYSVSKALKTVMLKDKSYDLIDEKDFPDKALREAVMAQVGTRKGDLERFNGTLRLDNPAIQSLEGLNKFKKLAQLDLIGLSRITKLDRSVLPANMKPGKDTLETVLETYKKDNKEEPATIPPVSLKVSGLTGLKELDLSGFDRETLAGLDAATLTSLEKVDISGNKLDLAPGTENRQIFDTMLSTISNHVGSNEQTVKFDKQKPTGHYPDTYGKTSLRLPVANEKVDLQSQLLFGTVTNQGTLINSEADYKAYQNHKIAGRSFVDSNYHYNNFKVSYENYTVKVTDSTLGTTTDKTLATDKEETYKVDFFSPADKTKAVHTAKVIVGDEKTMMVNLAEGATVIGGSADPVNARKVFDGQLGSETDNISLGWDSKQSIIFKLKEDGLIKHWRFFNDSARNPETTNKPIQEASLQIFNIKDYNLDNLLENPNKFDDEKYWITVDTYSAQGERATAFSNTLNNITSKYWRVVFDTKGDRYSSPVVPELQILGYPLPNADTIMKTVTTAKELSQQKDKFSQKMLDELKIKEMALETSLNSKIFDVTAINANAGVLKDCIEKRQLLKK

SEQ ID NO: 165 - DNA, 3813 bp, Artificial Sequence
  SYNTHETIC FUSION PROTEN
atgggcagcagccatcatcatcatcatcacagcagcggcctggtgccgcgcggcagccatatgcagtatcaggcaaattggcagagtctggatcagcgcccgaccccggcatggtttgaagatgccaaatttggcatttttatccattggggcctgtatagtgtgccgagctgggcaaccaaaagtaatgccgatggctttggtagcggctatagtgaatggtattggcagcgtctgtttgcaaaaaatctgaaaattcatccggaatttgtggaatttcataaaaaaaacttcggcgataagaactatcaggattttgtgcagaattttaaggcagaactgtttcagccgaatgattgggcaaatatttttgaacaggcaggcgccaaatatgttgtgctgaccagtaaacatcatgaaggttttaccctgtggccgagcaaagaaagctggaattggaatagtgttgatgtgggcccgcatcgtgatctggcaggtgatctgatgaccgccgtgcgtgcaaaaaatttaaaaatgggttattactacagcctgtatgaatggtttaatccggtttataaagccgatgtgaatacctatgttagcgaacgtatgctgccgcagatgaaagatctggttacccgctataaaccggatattctgtggaccgatggcgaatgggattatccggcaaaaacctggcgtagcgaagaatttctggcatggctgtttaatgaaagtaatgttaaaaacgagatcgtggttaatgatcgttggggtagtgataccaaaagcaaacatggtagctttgccaccagtgaatatggccacggtggtaccgataataccgaaaccaccggtggctttcagcgtccgtgggaagaatgccgtggtatgggtgaaagttttggctataatcgtaatgaaaacctggatagctatcagaccggcgaagcactggtgcatcagctgattgatattgttgccaaaggcggtaatctgctgctgaatattggcccggcagccgatggcaccattccggttattatgcaggaacgcctgcatgaaattggcagctggctgaaagttaatggcagcgcaatttatggcacccgtcgctggagcaaagcaccggcatataccaaagaaagtaccctgtattttacccagaaaggtaaaaatctgaacgcaattacccgcaaatgggaagaaaccattagcattcagaatgtggcaaaaccgagtaaagttaccctgctgggttataaaggtgaagttaaatttacctacaagaacggtaccctgaccattatggccccgagcgtgaatccgagcaatattccgtgtcagtatgcctggacctatgaaattgaaaatgcactgggatccgaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcagacaattggtgttaacgaattaaatggacgtacaggtttatctaaagattatcctgatactcctgaggggaacaaagctttagcagcagccattgtcaaggcatttgtaactgatcgtggtgtcgatggactagatattgatattgagcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggattaa

SEQ ID NO: 166 - protein, 1270 aa, Artificial Sequence
  SYNTHETIC FUSION PROTEN
MGSSHHHHHHSSGLVPRGSHMQYQANWQSLDQRPTPAWFEDAKFGIFIHWGLYSVPSWATKSNADGFGSGYSEWYWQRLFAKNLKIHPEFVEFHKKNFGDKNYQDFVQNFKAELFQPNDWANIFEQAGAKYVVLTSKHHEGFTLWPSKESWNWNSVDVGPHRDLAGDLMTAVRAKNLKMGYYYSLYEWFNPVYKADVNTYVSERMLPQMKDLVTRYKPDILWTDGEWDYPAKTWRSEEFLAWLFNESNVKNEIVVNDRWGSDTKSKHGSFATSEYGHGGTDNTETTGGFQRPWEECRGMGESFGYNRNENLDSYQTGEALVHQLIDIVAKGGNLLLNIGPAADGTIPVIMQERLHEIGSWLKVNGSAIYGTRRWSKAPAYTKESTLYFTQKGKNLNAITRKWEETISIQNVAKPSKVTLLGYKGEVKFTYKNGTLTIMAPSVNPSNIPCQYAWTYEIENALGSEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQTIGVNELNGRTGLSKDYPDTPEGNKALAAAIVKAFVTDRGVDGLDIDIEHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKD

SEQ ID NO: 167 - DNA, 3813 bp, Artificial Sequence
  SYNTHETIC FUSION PROTEN
atgggcagcagccatcatcatcatcatcacagcagcggcctggtgccgcgcggcagccatatgcagtatcaggcaaattggcagagtctggatcagcgcccgaccccggcatggtttgaagatgccaaatttggcatttttatccattggggcctgtatagtgtgccgagctgggcaaccaaaagtaatgccgatggctttggtagcggctatagtgaatggtattggcagcgtctgtttgcaaaaaatctgaaaattcatccggaatttgtggaatttcataaaaaaaacttcggcgataagaactatcaggattttgtgcagaattttaaggcagaactgtttcagccgaatgattgggcaaatatttttgaacaggcaggcgccaaatatgttgtgctgaccagtaaacatcatgaaggttttaccctgtggccgagcaaagaaagctggaattggaatagtgttgatgtgggcccgcatcgtgatctggcaggtgatctgatgaccgccgtgcgtgcaaaaaatttaaaaatgggttattactacagcctgtatgaatggtttaatccggtttataaagccgatgtgaatacctatgttagcgaacgtatgctgccgcagatgaaagatctggttacccgctataaaccggatattctgtggaccgatggcgaatgggattatccggcaaaaacctggcgtagcgaagaatttctggcatggctgtttaatgaaagtaatgttaaaaacgagatcgtggttaatgatcgttggggtagtgataccaaaagcaaacatggtagctttgccaccagtgaatatggccacggtggtaccgataataccgaaaccaccggtggctttcagcgtccgtgggaagaatgccgtggtatgggtgaaagttttggctataatcgtaatgaaaacctggatagctatcagaccggcgaagcactggtgcatcagctgattgatattgttgccaaaggcggtaatctgctgctgaatattggcccggcagccgatggcaccattccggttattatgcaggaacgcctgcatgaaattggcagctggctgaaagttaatggcagcgcaatttatggcacccgtcgctggagcaaagcaccggcatataccaaagaaagtaccctgtattttacccagaaaggtaaaaatctgaacgcaattacccgcaaatgggaagaaaccattagcattcagaatgtggcaaaaccgagtaaagttaccctgctgggttataaaggtgaagttaaatttacctacaagaacggtaccctgaccattatggccccgagcgtgaatccgagcaatattccgtgtcagtatgcctggacctatgaaattgaaaatgcactgggatccgaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcaggaaattggtgttaacgaattaaatggacgtacaggtttatctaaagattatcctgatactcctgaggggaacaaagctttagcagcagccattgtcaaggcatttgtaactgatcgtggtgtcgatggactagatattgatattgagcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggattaa

SEQ ID NO: 168 - protein, 1270 aa, Artificial Sequence
  SYNTHETIC FUSION PROTEN
MGSSHHHHHHSSGLVPRGSHMQYQANWQSLDQRPTPAWFEDAKFGIFIHWGLYSVPSWATKSNADGFGSGYSEWYWQRLFAKNLKIHPEFVEFHKKNFGDKNYQDFVQNFKAELFQPNDWANIFEQAGAKYVVLTSKHHEGFTLWPSKESWNWNSVDVGPHRDLAGDLMTAVRAKNLKMGYYYSLYEWFNPVYKADVNTYVSERMLPQMKDLVTRYKPDILWTDGEWDYPAKTWRSEEFLAWLFNESNVKNEIVVNDRWGSDTKSKHGSFATSEYGHGGTDNTETTGGFQRPWEECRGMGESFGYNRNENLDSYQTGEALVHQLIDIVAKGGNLLLNIGPAADGTIPVIMQERLHEIGSWLKVNGSAIYGTRRWSKAPAYTKESTLYFTQKGKNLNAITRKWEETISIQNVAKPSKVTLLGYKGEVKFTYKNGTLTIMAPSVNPSNIPCQYAWTYEIENALGSEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQEIGVNELNGRTGLSKDYPDTPEGNKALAAAIVKAFVTDRGVDGLDIDIEHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKD

SEQ ID NO: 169 - DNA, 3813 bp, Artificial Sequence
  SYNTHETIC FUSION PROTEN
atgggcagcagccatcatcatcatcatcacagcagcggcctggtgccgcgcggcagccatatgcagtatcaggcaaattggcagagtctggatcagcgcccgaccccggcatggtttgaagatgccaaatttggcatttttatccattggggcctgtatagtgtgccgagctgggcaaccaaaagtaatgccgatggctttggtagcggctatagtgaatggtattggcagcgtctgtttgcaaaaaatctgaaaattcatccggaatttgtggaatttcataaaaaaaacttcggcgataagaactatcaggattttgtgcagaattttaaggcagaactgtttcagccgaatgattgggcaaatatttttgaacaggcaggcgccaaatatgttgtgctgaccagtaaacatcatgaaggttttaccctgtggccgagcaaagaaagctggaattggaatagtgttgatgtgggcccgcatcgtgatctggcaggtgatctgatgaccgccgtgcgtgcaaaaaatttaaaaatgggttattactacagcctgtatgaatggtttaatccggtttataaagccgatgtgaatacctatgttagcgaacgtatgctgccgcagatgaaagatctggttacccgctataaaccggatattctgtggaccgatggcgaatgggattatccggcaaaaacctggcgtagcgaagaatttctggcatggctgtttaatgaaagtaatgttaaaaacgagatcgtggttaatgatcgttggggtagtgataccaaaagcaaacatggtagctttgccaccagtgaatatggccacggtggtaccgataataccgaaaccaccggtggctttcagcgtccgtgggaagaatgccgtggtatgggtgaaagttttggctataatcgtaatgaaaacctggatagctatcagaccggcgaagcactggtgcatcagctgattgatattgttgccaaaggcggtaatctgctgctgaatattggcccggcagccgatggcaccattccggttattatgcaggaacgcctgcatgaaattggcagctggctgaaagttaatggcagcgcaatttatggcacccgtcgctggagcaaagcaccggcatataccaaagaaagtaccctgtattttacccagaaaggtaaaaatctgaacgcaattacccgcaaatgggaagaaaccattagcattcagaatgtggcaaaaccgagtaaagttaccctgctgggttataaaggtgaagttaaatttacctacaagaacggtaccctgaccattatggccccgagcgtgaatccgagcaatattccgtgtcagtatgcctggacctatgaaattgaaaatgcactgggatccgaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcagatgattggtgttaacgaattaaatggacgtacaggtttatctaaagattatcctgatactcctgaggggaacaaagctttagcagcagccattgtcaaggcatttgtaactgatcgtggtgtcgatggactagatattgatattgagcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggattaa

SEQ ID NO: 170 - protein, 1270 aa, Artificial Sequence
  SYNTHETIC FUSION PROTEN
MGSSHHHHHHSSGLVPRGSHMQYQANWQSLDQRPTPAWFEDAKFGIFIHWGLYSVPSWATKSNADGFGSGYSEWYWQRLFAKNLKIHPEFVEFHKKNFGDKNYQDFVQNFKAELFQPNDWANIFEQAGAKYVVLTSKHHEGFTLWPSKESWNWNSVDVGPHRDLAGDLMTAVRAKNLKMGYYYSLYEWFNPVYKADVNTYVSERMLPQMKDLVTRYKPDILWTDGEWDYPAKTWRSEEFLAWLFNESNVKNEIVVNDRWGSDTKSKHGSFATSEYGHGGTDNTETTGGFQRPWEECRGMGESFGYNRNENLDSYQTGEALVHQLIDIVAKGGNLLLNIGPAADGTIPVIMQERLHEIGSWLKVNGSAIYGTRRWSKAPAYTKESTLYFTQKGKNLNAITRKWEETISIQNVAKPSKVTLLGYKGEVKFTYKNGTLTIMAPSVNPSNIPCQYAWTYEIENALGSEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQMIGVNELNGRTGLSKDYPDTPEGNKALAAAIVKAFVTDRGVDGLDIDIEHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKD

SEQ ID NO: 171 - DNA, 3813 bp, Artificial Sequence
  SYNTHETIC FUSION PROTEN
atgggcagcagccatcatcatcatcatcacagcagcggcctggtgccgcgcggcagccatatgcagtatcaggcaaattggcagagtctggatcagcgcccgaccccggcatggtttgaagatgccaaatttggcatttttatccattggggcctgtatagtgtgccgagctgggcaaccaaaagtaatgccgatggctttggtagcggctatagtgaatggtattggcagcgtctgtttgcaaaaaatctgaaaattcatccggaatttgtggaatttcataaaaaaaacttcggcgataagaactatcaggattttgtgcagaattttaaggcagaactgtttcagccgaatgattgggcaaatatttttgaacaggcaggcgccaaatatgttgtgctgaccagtaaacatcatgaaggttttaccctgtggccgagcaaagaaagctggaattggaatagtgttgatgtgggcccgcatcgtgatctggcaggtgatctgatgaccgccgtgcgtgcaaaaaatttaaaaatgggttattactacagcctgtatgaatggtttaatccggtttataaagccgatgtgaatacctatgttagcgaacgtatgctgccgcagatgaaagatctggttacccgctataaaccggatattctgtggaccgatggcgaatgggattatccggcaaaaacctggcgtagcgaagaatttctggcatggctgtttaatgaaagtaatgttaaaaacgagatcgtggttaatgatcgttggggtagtgataccaaaagcaaacatggtagctttgccaccagtgaatatggccacggtggtaccgataataccgaaaccaccggtggctttcagcgtccgtgggaagaatgccgtggtatgggtgaaagttttggctataatcgtaatgaaaacctggatagctatcagaccggcgaagcactggtgcatcagctgattgatattgttgccaaaggcggtaatctgctgctgaatattggcccggcagccgatggcaccattccggttattatgcaggaacgcctgcatgaaattggcagctggctgaaagttaatggcagcgcaatttatggcacccgtcgctggagcaaagcaccggcatataccaaagaaagtaccctgtattttacccagaaaggtaaaaatctgaacgcaattacccgcaaatgggaagaaaccattagcattcagaatgtggcaaaaccgagtaaagttaccctgctgggttataaaggtgaagttaaatttacctacaagaacggtaccctgaccattatggccccgagcgtgaatccgagcaatattccgtgtcagtatgcctggacctatgaaattgaaaatgcactgggatccgaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcagacaattggtgttaacgaattaaatggacgtacaggtttatctaaagattatcctgatactcctgaggggaacaaagctttagcagcagccattgtcaaggcatttgtaactgatcgtggtgtcgatggactagatattatgattgagcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggattaa

SEQ ID NO: 172 - protein, 1270 aa, Artificial Sequence
  SYNTHETIC FUSION PROTEN
MGSSHHHHHHSSGLVPRGSHMQYQANWQSLDQRPTPAWFEDAKFGIFIHWGLYSVPSWATKSNADGFGSGYSEWYWQRLFAKNLKIHPEFVEFHKKNFGDKNYQDFVQNFKAELFQPNDWANIFEQAGAKYVVLTSKHHEGFTLWPSKESWNWNSVDVGPHRDLAGDLMTAVRAKNLKMGYYYSLYEWFNPVYKADVNTYVSERMLPQMKDLVTRYKPDILWTDGEWDYPAKTWRSEEFLAWLFNESNVKNEIVVNDRWGSDTKSKHGSFATSEYGHGGTDNTETTGGFQRPWEECRGMGESFGYNRNENLDSYQTGEALVHQLIDIVAKGGNLLLNIGPAADGTIPVIMQERLHEIGSWLKVNGSAIYGTRRWSKAPAYTKESTLYFTQKGKNLNAITRKWEETISIQNVAKPSKVTLLGYKGEVKFTYKNGTLTIMAPSVNPSNIPCQYAWTYEIENALGSEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQTIGVNELNGRTGLSKDYPDTPEGNKALAAAIVKAFVTDRGVDGLDIMIEHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKD

SEQ ID NO: 173 - DNA, 3024 bp, Artificial Sequence
  SYNTHETIC FUSION PROTEN
atgggcagcagccatcatcatcatcatcacagcagcggcctggtgccgcgcggcagccatatgggtaccctgcagggatccaaagataagtcgtatgatctgattgatgagaaagatttcccagataaggctttgcgagaagctgtgatggcgcaggttggaaccagaaaaggtgatttggaacgtttcaatggcacattacgattggataatccagcgattcaaagtttagaaggtctaaataaatttaaaaaattagctcaattagacttgattggcttatctcgcattacaaagctcgaccgttctgttttacccgctaatatgaagccaggcaaagataccttggaaacagttcttgaaacctataaaaaggataacaaagaagaacctgctactatcccaccagtatctttgaaggtttctggtttaactggtctgaaagaattagatttgtcaggttttgaccgtgaaaccttggctggtcttgatgccgctactctaacgtctttagaaaaagttgatatttctggcaacaaacttgatttggctccaggaacagaaaatcgacaaatttttgatactatgctatcaactatcagcaatcatgttggaagcaatgaacaaacagtgaaatttgacaagcaaaaaccaactgggcattacccagatacctatgggaaaactagtctgcgcttaccagtggcaaatgaaaaagttgatttgcaaagccagcttttgtttgggactgtgacaaatcaaggaaccctaatcaatagcgaagcagactataaggcttaccaaaatcataaaattgctggacgtagctttgttgattcaaactatcattacaataactttaaagtttcttatgagaactataccgttaaagtaactgattccacattgggaaccactactgacaaaacgctagcaactgataaagaagagacctataaggttgacttctttagcccagcagataagacaaaagctgttcatactgctaaagtgattgttggtgacgaaaaaaccatgatggttaatttggcagaaggcgcaacagttattggaggaagtgctgatcctgtaaatgcaagaaaggtatttgatgggcaactgggcagtgagactgataatatctctttaggatgggattctaagcaaagtattatatttaaattgaaagaagatggattaataaagcattggcgtttcttcaatgattcagcccgaaatcctgagacaaccaataaacctattcaggaagcaagtctacaaatttttaatatcaaagattataatctagataatttgttggaaaatcccaataaatttgatgatgaaaaatattggattactgtagatacttacagtgcacaaggagagagagctactgcattcagtaatacattaaataatattactagtaaatattggcgagttgtctttgatactaaaggagatagatatagttcgccagtagtccctgaactccaaattttaggttatccgttacctaacgccgacactatcatgaaaacagtaactactgctaaagagttatctcaacaaaaagataagttttctcaaaagatgcttgatgagttaaaaataaaagagatggctttagaaacttctttgaacagtaagatttttgatgtaactgctattaatgctaatgctggagttttgaaagattgtattgagaaaaggcagctgctaaaaaaaggcggtgcatttagtcagcagaaatatcagccgacccaggcaaatctgaaagcacgtaccgaatttcaggatgaaaaatttggtatgttcatccatttcggcctgtatagcgaactgggtcgtggcgaatgggttatgaataatgataaaattccggttaacgactacgcaaaactgaaagatttttttaacccgattggctttaacgcaaaagaatatgtgagcatggcaaaaaatgcaggtgttaaatatatcaccctggtgacccgtcatcatgatggttttagcatgtggaataccaaatatagcgattttaacatcatgaacaccccgtttaaacgcgatctggttaaagaactggcaaatgaatgccataaacagggcgtgaaaattgccttttattatagcctgctggattggacccgtaccgattatagttattggaccggccgcaccggtaaaggtaccggccgtaccgaaaaaggtaattggaatgattatatccagttcatgaagaatcagctgaccgaactgctgaccaattatggcgaagttagcggtatttggtttgatggctattgggatcagatggaagaagaaaaagccggtcgtagtgaaaaaacctatattgattggaaaatgccggaaatttacgaactgattcataaactgcagccgcagtgtctggtgggtaataatcatcatattaccccgctggaaggcgaagattttcagatgtttgaacgcgatattccgggccagaatgaacatggtctgagttttcagaaaccgagccagctgccgctggaaacctgcgcaaccctgaatgatagttggggctttgatctgaaagataataaaaataagaccttcaaggagttcctgaatctgctggtgaatgccgcaggtagtaatgccaatctgctgatgaatattggcccgatgccgaatggtaaagttccgcagccgtttattaatagctttaaagaaatgggcgagtggattcgcgtttatggtgaaagcatttatggtacccgcggcggttatctgccgctgcagaaatggggcgcagtgacccagaaaagcggtaaaatttatgtgcatattctgaaaaacaacgagggtaaagccattaccctggaaaaatttccgtttaaaaagattaacagcgcatatctgctgaaagataaaaaaaccgtgaaatataccctgaaaaacaataccctgacctttgatagttatgccgttgatgatcagaatccggatgccgtgattgtgtttgaaggcaagtaa

SEQ ID NO: 174 - protein, 1007 aa, Artificial Sequence
  SYNTHETIC FUSION PROTEN
MGSSHHHHHHSSGLVPRGSHMGTLQGSKDKSYDLIDEKDFPDKALREAVMAQVGTRKGDLERFNGTLRLDNPAIQSLEGLNKFKKLAQLDLIGLSRITKLDRSVLPANMKPGKDTLETVLETYKKDNKEEPATIPPVSLKVSGLTGLKELDLSGFDRETLAGLDAATLTSLEKVDISGNKLDLAPGTENRQIFDTMLSTISNHVGSNEQTVKFDKQKPTGHYPDTYGKTSLRLPVANEKVDLQSQLLFGTVTNQGTLINSEADYKAYQNHKIAGRSFVDSNYHYNNFKVSYENYTVKVTDSTLGTTTDKTLATDKEETYKVDFFSPADKTKAVHTAKVIVGDEKTMMVNLAEGATVIGGSADPVNARKVFDGQLGSETDNISLGWDSKQSIIFKLKEDGLIKHWRFFNDSARNPETTNKPIQEASLQIFNIKDYNLDNLLENPNKFDDEKYWITVDTYSAQGERATAFSNTLNNITSKYWRVVFDTKGDRYSSPVVPELQILGYPLPNADTIMKTVTTAKELSQQKDKFSQKMLDELKIKEMALETSLNSKIFDVTAINANAGVLKDCIEKRQLLKKGGAFSQQKYQPTQANLKARTEFQDEKFGMFIHFGLYSELGRGEWVMNNDKIPVNDYAKLKDFFNPIGFNAKEYVSMAKNAGVKYITLVTRHHDGFSMWNTKYSDFNIMNTPFKRDLVKELANECHKQGVKIAFYYSLLDWTRTDYSYWTGRTGKGTGRTEKGNWNDYIQFMKNQLTELLTNYGEVSGIWFDGYWDQMEEEKAGRSEKTYIDWKMPEIYELIHKLQPQCLVGNNHHITPLEGEDFQMFERDIPGQNEHGLSFQKPSQLPLETCATLNDSWGFDLKDNKNKTFKEFLNLLVNAAGSNANLLMNIGPMPNGKVPQPFINSFKEMGEWIRVYGESIYGTRGGYLPLQKWGAVTQKSGKIYVHILKNNEGKAITLEKFPFKKINSAYLLKDKKTVKYTLKNNTLTFDSYAVDDQNPDAVIVFEGK

SEQ ID NO: 175 - DNA, 2751 bp, Artificial Sequence
  SYNTHETIC FUSION PROTEN
atgggcagcagccatcatcatcatcatcacagcagcggcctggtgccgcgcggcagccatatgggtaccctgcagggatccaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggatggcggtgcatttagtcagcagaaatatcagccgacccaggcaaatctgaaagcacgtaccgaatttcaggatgaaaaatttggtatgttcatccatttcggcctgtatagcgaactgggtcgtggcgaatgggttatgaataatgataaaattccggttaacgactacgcaaaactgaaagatttttttaacccgattggctttaacgcaaaagaatatgtgagcatggcaaaaaatgcaggtgttaaatatatcaccctggtgacccgtcatcatgatggttttagcatgtggaataccaaatatagcgattttaacatcatgaacaccccgtttaaacgcgatctggttaaagaactggcaaatgaatgccataaacagggcgtgaaaattgccttttattatagcctgctggattggacccgtaccgattatagttattggaccggccgcaccggtaaaggtaccggccgtaccgaaaaaggtaattggaatgattatatccagttcatgaagaatcagctgaccgaactgctgaccaattatggcgaagttagcggtatttggtttgatggctattgggatcagatggaagaagaaaaagccggtcgtagtgaaaaaacctatattgattggaaaatgccggaaatttacgaactgattcataaactgcagccgcagtgtctggtgggtaataatcatcatattaccccgctggaaggcgaagattttcagatgtttgaacgcgatattccgggccagaatgaacatggtctgagttttcagaaaccgagccagctgccgctggaaacctgcgcaaccctgaatgatagttggggctttgatctgaaagataataaaaataagaccttcaaggagttcctgaatctgctggtgaatgccgcaggtagtaatgccaatctgctgatgaatattggcccgatgccgaatggtaaagttccgcagccgtttattaatagctttaaagaaatgggcgagtggattcgcgtttatggtgaaagcatttatggtacccgcggcggttatctgccgctgcagaaatggggcgcagtgacccagaaaagcggtaaaatttatgtgcatattctgaaaaacaacgagggtaaagccattaccctggaaaaatttccgtttaaaaagattaacagcgcatatctgctgaaagataaaaaaaccgtgaaatataccctgaaaaacaataccctgacctttgatagttatgccgttgatgatcagaatccggatgccgtgattgtgtttgaaggcaagtaa

SEQ ID NO: 176 - protein, 916 aa, Artificial Sequence
  SYNTHETIC FUSION PROTEN
MGSSHHHHHHSSGLVPRGSHMGTLQGSTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKDGGAFSQQKYQPTQANLKARTEFQDEKFGMFIHFGLYSELGRGEWVMNNDKIPVNDYAKLKDFFNPIGFNAKEYVSMAKNAGVKYITLVTRHHDGFSMWNTKYSDFNIMNTPFKRDLVKELANECHKQGVKIAFYYSLLDWTRTDYSYWTGRTGKGTGRTEKGNWNDYIQFMKNQLTELLTNYGEVSGIWFDGYWDQMEEEKAGRSEKTYIDWKMPEIYELIHKLQPQCLVGNNHHITPLEGEDFQMFERDIPGQNEHGLSFQKPSQLPLETCATLNDSWGFDLKDNKNKTFKEFLNLLVNAAGSNANLLMNIGPMPNGKVPQPFINSFKEMGEWIRVYGESIYGTRGGYLPLQKWGAVTQKSGKIYVHILKNNEGKAITLEKFPFKKINSAYLLKDKKTVKYTLKNNTLTFDSYAVDDQNPDAVIVFEGK

SEQ ID NO: 177 - DNA, 4299 bp, Artificial Sequence
  SYNTHETIC FUSION PROTEN
atgggcagcagccatcatcatcatcatcacagcagcggcctggtgccgcgcggcagccatatgacccaccatgattcactcaatactgtaaaagcggaggagaagactgttcaggttcagaaaggattaccttctatcgatagcttgcattatctgtcagagaatagcaaaaaagaatttaaagaagaactctcaaaagcggggcaagaatctcaaaaggtcaaagagatattagcaaaagctcagcaggcagataaacaagctcaagaacttgccaaaatgaaaattcctgagaaaataccgatgaaaccgttacatggttctctctacggtggttactttagaacttggcatgacaaaacatcagatccaacagaaaaagacaaagttaactcgatgggagagcttcctaaagaagtagatctagcctttattttccacgattggacaaaagattatagccttttttggaaagaattggccaccaaacatgtgccaaagttaaacaagcaagggacacgtgtcattcgtaccattccatggcgtttcctagctgggggtgataacagtggtattgcagaagataccagtaaatacccaaatacaccagagggaaataaagctttagccaaagctattgttgatgaatatgtttataaatacaaccttgatggcttagatgtggatgttgaacatgatagtattccaaaagttgacaaaaaagaagatacagcaggcgtagaacgctctattcaagtgtttgaagaaattgggaaattaattggaccaaaaggtgttgataaatcgcggttatttattatggatagcacctacatggctgataaaaacccattgattgagcgaggagctccttatattaatttattactggtacaggtctatggttcacaaggagagaaaggtggttgggagcctgtttctaatcgacctgaaaaaacaatggaagaacgatggcaaggttatagcaagtatattcgtcctgaacaatacatgattggtttttctttctatgaggaaaatgctcaagaagggaatctttggtatgatattaattctcgcaaggacgaggacaaagcaaatggaattaacactgacataactggaacgcgtgccgaacggtatgcaaggtggcaacctaagacaggtggggttaagggaggtatcttctcctacgctattgaccgagatggtgtagctcatcaacctaaaaaatatgctaaacagaaagagtttaaggacgcaactgataacatcttccactcagattatagtgtctccaaggcattaaagacagttatgctaaaagataagtcgtatgatctgattgatgagaaagatttcccagataaggctttgcgagaagctgtgatggcgcaggttggaaccagaaaaggtgatttggaacgtttcaatggcacattacgattggataatccagcgattcaaagtttagaaggtctaaataaatttaaaaaattagctcaattagacttgattggcttatctcgcattacaaagctcgaccgttctgttttacccgctaatatgaagccaggcaaagataccttggaaacagttcttgaaacctataaaaaggataacaaagaagaacctgctactatcccaccagtatctttgaaggtttctggtttaactggtctgaaagaattagatttgtcaggttttgaccgtgaaaccttggctggtcttgatgccgctactctaacgtctttagaaaaagttgatatttctggcaacaaacttgatttggctccaggaacagaaaatcgacaaatttttgatactatgctatcaactatcagcaatcatgttggaagcaatgaacaaacagtgaaatttgacaagcaaaaaccaactgggcattacccagatacctatgggaaaactagtctgcgcttaccagtggcaaatgaaaaagttgatttgcaaagccagcttttgtttgggactgtgacaaatcaaggaaccctaatcaatagcgaagcagactataaggcttaccaaaatcataaaattgctggacgtagctttgttgattcaaactatcattacaataactttaaagtttcttatgagaactataccgttaaagtaactgattccacattgggaaccactactgacaaaacgctagcaactgataaagaagagacctataaggttgacttctttagcccagcagataagacaaaagctgttcatactgctaaagtgattgttggtgacgaaaaaaccatgatggttaatttggcagaaggcgcaacagttattggaggaagtgctgatcctgtaaatgcaagaaaggtatttgatgggcaactgggcagtgagactgataatatctctttaggatgggattctaagcaaagtattatatttaaattgaaagaagatggattaataaagcattggcgtttcttcaatgattcagcccgaaatcctgagacaaccaataaacctattcaggaagcaagtctacaaatttttaatatcaaagattataatctagataatttgttggaaaatcccaataaatttgatgatgaaaaatattggattactgtagatacttacagtgcacaaggagagagagctactgcattcagtaatacattaaataatattactagtaaatattggcgagttgtctttgatactaaaggagatagatatagttcgccagtagtccctgaactccaaattttaggttatccgttacctaacgccgacactatcatgaaaacagtaactactgctaaagagttatctcaacaaaaagataagttttctcaaaagatgcttgatgagttaaaaataaaagagatggctttagaaacttctttgaacagtaagatttttgatgtaactgctattaatgctaatgctggagttttgaaagattgtattgagaaaaggcagctgctaaaaaaaggatccggtgcttttagtcagcagaaatatcagccgacccaggcaaatctgaaagcacgtaccgaatttcaggatgaaaaatttggtatgttcatccatttcggcctgtatagcgaactgggtcgtggcgaatgggttatgaataatgataaaattccggttaacgactacgcaaaactgaaagatttttttaacccgattggctttaacgcaaaagaatatgtgagcatggcaaaaaatgcaggtgttaaatatatcaccctggtgacccgtcatcatgatggttttagcatgtggaataccaaatatagcgattttaacatcatgaacaccccgtttaaacgcgatctggttaaagaactggcaaatgaatgccataaacagggcgtgaaaattgccttttattatagcctgctggattggacccgtaccgattatagttattggaccggccgcaccggtaaaggtaccggccgtaccgaaaaaggtaattggaatgattatatccagttcatgaagaatcagctgaccgaactgctgaccaattatggcgaagttagcggtatttggtttgatggctattgggatcagatggaagaagaaaaagccggtcgtagtgaaaaaacctatattgattggaaaatgccggaaatttacgaactgattcataaactgcagccgcagtgtctggtgggtaataatcatcatattaccccgctggaaggcgaagattttcagatgtttgaacgcgatattccgggccagaatgaacatggtctgagttttcagaaaccgagccagctgccgctggaaacctgcgcaaccctgaatgatagttggggctttgatctgaaagataataaaaataagaccttcaaggagttcctgaatctgctggtgaatgccgcaggtagtaatgccaatctgctgatgaatattggcccgatgccgaatggtaaagttccgcagccgtttattaatagctttaaagaaatgggcgagtggattcgcgtttatggtgaaagcatttatggtacccgcggcggttatctgccgctgcagaaatggggcgcagtgacccagaaaagcggtaaaatttatgtgcatattctgaaaaacaacgagggtaaagccattaccctggaaaaatttccgtttaaaaagattaacagcgcatatctgctgaaagataaaaaaaccgtgaaatataccctgaaaaacaataccctgacctttgatagttatgccgttgatgatcagaatccggatgccgtgattgtgtttgaaggcaagggtacctggtctcatccgcagttcgagaaataa

SEQ ID NO: 178 - protein, 1432 aa, Artificial Sequence
  SYNTHETIC FUSION PROTEN
MGSSHHHHHHSSGLVPRGSHMTHHDSLNTVKAEEKTVQVQKGLPSIDSLHYLSENSKKEFKEELSKAGQESQKVKEILAKAQQADKQAQELAKMKIPEKIPMKPLHGSLYGGYFRTWHDKTSDPTEKDKVNSMGELPKEVDLAFIFHDWTKDYSLFWKELATKHVPKLNKQGTRVIRTIPWRFLAGGDNSGIAEDTSKYPNTPEGNKALAKAIVDEYVYKYNLDGLDVDVEHDSIPKVDKKEDTAGVERSIQVFEEIGKLIGPKGVDKSRLFIMDSTYMADKNPLIERGAPYINLLLVQVYGSQGEKGGWEPVSNRPEKTMEERWQGYSKYIRPEQYMIGFSFYEENAQEGNLWYDINSRKDEDKANGINTDITGTRAERYARWQPKTGGVKGGIFSYAIDRDGVAHQPKKYAKQKEFKDATDNIFHSDYSVSKALKTVMLKDKSYDLIDEKDFPDKALREAVMAQVGTRKGDLERFNGTLRLDNPAIQSLEGLNKFKKLAQLDLIGLSRITKLDRSVLPANMKPGKDTLETVLETYKKDNKEEPATIPPVSLKVSGLTGLKELDLSGFDRETLAGLDAATLTSLEKVDISGNKLDLAPGTENRQIFDTMLSTISNHVGSNEQTVKFDKQKPTGHYPDTYGKTSLRLPVANEKVDLQSQLLFGTVTNQGTLINSEADYKAYQNHKIAGRSFVDSNYHYNNFKVSYENYTVKVTDSTLGTTTDKTLATDKEETYKVDFFSPADKTKAVHTAKVIVGDEKTMMVNLAEGATVIGGSADPVNARKVFDGQLGSETDNISLGWDSKQSIIFKLKEDGLIKHWRFFNDSARNPETTNKPIQEASLQIFNIKDYNLDNLLENPNKFDDEKYWITVDTYSAQGERATAFSNTLNNITSKYWRVVFDTKGDRYSSPVVPELQILGYPLPNADTIMKTVTTAKELSQQKDKFSQKMLDELKIKEMALETSLNSKIFDVTAINANAGVLKDCIEKRQLLKKGSGAFSQQKYQPTQANLKARTEFQDEKFGMFIHFGLYSELGRGEWVMNNDKIPVNDYAKLKDFFNPIGFNAKEYVSMAKNAGVKYITLVTRHHDGFSMWNTKYSDFNIMNTPFKRDLVKELANECHKQGVKIAFYYSLLDWTRTDYSYWTGRTGKGTGRTEKGNWNDYIQFMKNQLTELLTNYGEVSGIWFDGYWDQMEEEKAGRSEKTYIDWKMPEIYELIHKLQPQCLVGNNHHITPLEGEDFQMFERDIPGQNEHGLSFQKPSQLPLETCATLNDSWGFDLKDNKNKTFKEFLNLLVNAAGSNANLLMNIGPMPNGKVPQPFINSFKEMGEWIRVYGESIYGTRGGYLPLQKWGAVTQKSGKIYVHILKNNEGKAITLEKFPFKKINSAYLLKDKKTVKYTLKNNTLTFDSYAVDDQNPDAVIVFEGKGTWSHPQFEK

SEQ ID NO: 179 - DNA, 4299 bp, Artificial Sequence
  SYNTHETIC FUSION PROTEN
atgggcagcagccatcatcatcatcatcacagcagcggcctggtgccgcgcggcagccatatgacccaccatgattcactcaatactgtaaaagcggaggagaagactgttcaggttcagaaaggattaccttctatcgatagcttgcattatctgtcagagaatagcaaaaaagaatttaaagaagaactctcaaaagcggggcaagaatctcaaaaggtcaaagagatattagcaaaagctcagcaggcagataaacaagctcaagaacttgccaaaatgaaaattcctgagaaaataccgatgaaaccgttacatggttctctctacggtggttactttagaacttggcatgacaaaacatcagatccaacagaaaaagacaaagttaactcgatgggagagcttcctaaagaagtagatctagcctttattttccacgattggacaaaagattatagccttttttggaaagaattggccaccaaacatgtgccaaagttaaacaagcaagggacacgtgtcattcgtaccattccatggcgtttcctagctgggggtgataacagtggtattgcagaagataccagtaaatacccaaatacaccagagggaaataaagctttagccaaagctattgttgatgaatatgtttataaatacaaccttgatggcttagatgtgcaggttgaacatgatagtattccaaaagttgacaaaaaagaagatacagcaggcgtagaacgctctattcaagtgtttgaagaaattgggaaattaattggaccaaaaggtgttgataaatcgcggttatttattatggatagcacctacatggctgataaaaacccattgattgagcgaggagctccttatattaatttattactggtacaggtctatggttcacaaggagagaaaggtggttgggagcctgtttctaatcgacctgaaaaaacaatggaagaacgatggcaaggttatagcaagtatattcgtcctgaacaatacatgattggtttttctttctatgaggaaaatgctcaagaagggaatctttggtatgatattaattctcgcaaggacgaggacaaagcaaatggaattaacactgacataactggaacgcgtgccgaacggtatgcaaggtggcaacctaagacaggtggggttaagggaggtatcttctcctacgctattgaccgagatggtgtagctcatcaacctaaaaaatatgctaaacagaaagagtttaaggacgcaactgataacatcttccactcagattatagtgtctccaaggcattaaagacagttatgctaaaagataagtcgtatgatctgattgatgagaaagatttcccagataaggctttgcgagaagctgtgatggcgcaggttggaaccagaaaaggtgatttggaacgtttcaatggcacattacgattggataatccagcgattcaaagtttagaaggtctaaataaatttaaaaaattagctcaattagacttgattggcttatctcgcattacaaagctcgaccgttctgttttacccgctaatatgaagccaggcaaagataccttggaaacagttcttgaaacctataaaaaggataacaaagaagaacctgctactatcccaccagtatctttgaaggtttctggtttaactggtctgaaagaattagatttgtcaggttttgaccgtgaaaccttggctggtcttgatgccgctactctaacgtctttagaaaaagttgatatttctggcaacaaacttgatttggctccaggaacagaaaatcgacaaatttttgatactatgctatcaactatcagcaatcatgttggaagcaatgaacaaacagtgaaatttgacaagcaaaaaccaactgggcattacccagatacctatgggaaaactagtctgcgcttaccagtggcaaatgaaaaagttgatttgcaaagccagcttttgtttgggactgtgacaaatcaaggaaccctaatcaatagcgaagcagactataaggcttaccaaaatcataaaattgctggacgtagctttgttgattcaaactatcattacaataactttaaagtttcttatgagaactataccgttaaagtaactgattccacattgggaaccactactgacaaaacgctagcaactgataaagaagagacctataaggttgacttctttagcccagcagataagacaaaagctgttcatactgctaaagtgattgttggtgacgaaaaaaccatgatggttaatttggcagaaggcgcaacagttattggaggaagtgctgatcctgtaaatgcaagaaaggtatttgatgggcaactgggcagtgagactgataatatctctttaggatgggattctaagcaaagtattatatttaaattgaaagaagatggattaataaagcattggcgtttcttcaatgattcagcccgaaatcctgagacaaccaataaacctattcaggaagcaagtctacaaatttttaatatcaaagattataatctagataatttgttggaaaatcccaataaatttgatgatgaaaaatattggattactgtagatacttacagtgcacaaggagagagagctactgcattcagtaatacattaaataatattactagtaaatattggcgagttgtctttgatactaaaggagatagatatagttcgccagtagtccctgaactccaaattttaggttatccgttacctaacgccgacactatcatgaaaacagtaactactgctaaagagttatctcaacaaaaagataagttttctcaaaagatgcttgatgagttaaaaataaaagagatggctttagaaacttctttgaacagtaagatttttgatgtaactgctattaatgctaatgctggagttttgaaagattgtattgagaaaaggcagctgctaaaaaaaggatccggtgcttttagtcagcagaaatatcagccgacccaggcaaatctgaaagcacgtaccgaatttcaggatgaaaaatttggtatgttcatccatttcggcctgtatagcgaactgggtcgtggcgaatgggttatgaataatgataaaattccggttaacgactacgcaaaactgaaagatttttttaacccgattggctttaacgcaaaagaatatgtgagcatggcaaaaaatgcaggtgttaaatatatcaccctggtgacccgtcatcatgatggttttagcatgtggaataccaaatatagcgattttaacatcatgaacaccccgtttaaacgcgatctggttaaagaactggcaaatgaatgccataaacagggcgtgaaaattgccttttattatagcctgctggattggacccgtaccgattatagttattggaccggccgcaccggtaaaggtaccggccgtaccgaaaaaggtaattggaatgattatatccagttcatgaagaatcagctgaccgaactgctgaccaattatggcgaagttagcggtatttggtttgatggctattgggatcagatggaagaagaaaaagccggtcgtagtgaaaaaacctatattgattggaaaatgccggaaatttacgaactgattcataaactgcagccgcagtgtctggtgggtaataatcatcatattaccccgctggaaggcgaagattttcagatgtttgaacgcgatattccgggccagaatgaacatggtctgagttttcagaaaccgagccagctgccgctggaaacctgcgcaaccctgaatgatagttggggctttgatctgaaagataataaaaataagaccttcaaggagttcctgaatctgctggtgaatgccgcaggtagtaatgccaatctgctgatgaatattggcccgatgccgaatggtaaagttccgcagccgtttattaatagctttaaagaaatgggcgagtggattcgcgtttatggtgaaagcatttatggtacccgcggcggttatctgccgctgcagaaatggggcgcagtgacccagaaaagcggtaaaatttatgtgcatattctgaaaaacaacgagggtaaagccattaccctggaaaaatttccgtttaaaaagattaacagcgcatatctgctgaaagataaaaaaaccgtgaaatataccctgaaaaacaataccctgacctttgatagttatgccgttgatgatcagaatccggatgccgtgattgtgtttgaaggcaagggtacctggtctcatccgcagttcgagaaataa

SEQ ID NO: 180 - protein, 1432 aa, Artificial Sequence
  SYNTHETIC FUSION PROTEN
MGSSHHHHHHSSGLVPRGSHMTHHDSLNTVKAEEKTVQVQKGLPSIDSLHYLSENSKKEFKEELSKAGQESQKVKEILAKAQQADKQAQELAKMKIPEKIPMKPLHGSLYGGYFRTWHDKTSDPTEKDKVNSMGELPKEVDLAFIFHDWTKDYSLFWKELATKHVPKLNKQGTRVIRTIPWRFLAGGDNSGIAEDTSKYPNTPEGNKALAKAIVDEYVYKYNLDGLDVQVEHDSIPKVDKKEDTAGVERSIQVFEEIGKLIGPKGVDKSRLFIMDSTYMADKNPLIERGAPYINLLLVQVYGSQGEKGGWEPVSNRPEKTMEERWQGYSKYIRPEQYMIGFSFYEENAQEGNLWYDINSRKDEDKANGINTDITGTRAERYARWQPKTGGVKGGIFSYAIDRDGVAHQPKKYAKQKEFKDATDNIFHSDYSVSKALKTVMLKDKSYDLIDEKDFPDKALREAVMAQVGTRKGDLERFNGTLRLDNPAIQSLEGLNKFKKLAQLDLIGLSRITKLDRSVLPANMKPGKDTLETVLETYKKDNKEEPATIPPVSLKVSGLTGLKELDLSGFDRETLAGLDAATLTSLEKVDISGNKLDLAPGTENRQIFDTMLSTISNHVGSNEQTVKFDKQKPTGHYPDTYGKTSLRLPVANEKVDLQSQLLFGTVTNQGTLINSEADYKAYQNHKIAGRSFVDSNYHYNNFKVSYENYTVKVTDSTLGTTTDKTLATDKEETYKVDFFSPADKTKAVHTAKVIVGDEKTMMVNLAEGATVIGGSADPVNARKVFDGQLGSETDNISLGWDSKQSIIFKLKEDGLIKHWRFFNDSARNPETTNKPIQEASLQIFNIKDYNLDNLLENPNKFDDEKYWITVDTYSAQGERATAFSNTLNNITSKYWRVVFDTKGDRYSSPVVPELQILGYPLPNADTIMKTVTTAKELSQQKDKFSQKMLDELKIKEMALETSLNSKIFDVTAINANAGVLKDCIEKRQLLKKGSGAFSQQKYQPTQANLKARTEFQDEKFGMFIHFGLYSELGRGEWVMNNDKIPVNDYAKLKDFFNPIGFNAKEYVSMAKNAGVKYITLVTRHHDGFSMWNTKYSDFNIMNTPFKRDLVKELANECHKQGVKIAFYYSLLDWTRTDYSYWTGRTGKGTGRTEKGNWNDYIQFMKNQLTELLTNYGEVSGIWFDGYWDQMEEEKAGRSEKTYIDWKMPEIYELIHKLQPQCLVGNNHHITPLEGEDFQMFERDIPGQNEHGLSFQKPSQLPLETCATLNDSWGFDLKDNKNKTFKEFLNLLVNAAGSNANLLMNIGPMPNGKVPQPFINSFKEMGEWIRVYGESIYGTRGGYLPLQKWGAVTQKSGKIYVHILKNNEGKAITLEKFPFKKINSAYLLKDKKTVKYTLKNNTLTFDSYAVDDQNPDAVIVFEGKGTWSHPQFEK

SEQ ID NO: 181 - DNA, 3810 bp, Artificial Sequence
  SYNTHETIC FUSION PROTEN
atgggcagcagccatcatcatcatcatcacagcagcggcctggtgccgcgcggcagccatatggaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcagacaattggtgttaacgaattaaatggacgtacaggtttatctaaagattatcctgatactcctgaggggaacaaagctttagcagcagccattgtcaaggcatttgtaactgatcgtggtgtcgatggactagatattgatattgagcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggatggatccggtgcttttagtcagcagaaatatcagccgacccaggcaaatctgaaagcacgtaccgaatttcaggatgaaaaatttggtatgttcatccatttcggcctgtatagcgaactgggtcgtggcgaatgggttatgaataatgataaaattccggttaacgactacgcaaaactgaaagatttttttaacccgattggctttaacgcaaaagaatatgtgagcatggcaaaaaatgcaggtgttaaatatatcaccctggtgacccgtcatcatgatggttttagcatgtggaataccaaatatagcgattttaacatcatgaacaccccgtttaaacgcgatctggttaaagaactggcaaatgaatgccataaacagggcgtgaaaattgccttttattatagcctgctggattggacccgtaccgattatagttattggaccggccgcaccggtaaaggtaccggccgtaccgaaaaaggtaattggaatgattatatccagttcatgaagaatcagctgaccgaactgctgaccaattatggcgaagttagcggtatttggtttgatggctattgggatcagatggaagaagaaaaagccggtcgtagtgaaaaaacctatattgattggaaaatgccggaaatttacgaactgattcataaactgcagccgcagtgtctggtgggtaataatcatcatattaccccgctggaaggcgaagattttcagatgtttgaacgcgatattccgggccagaatgaacatggtctgagttttcagaaaccgagccagctgccgctggaaacctgcgcaaccctgaatgatagttggggctttgatctgaaagataataaaaataagaccttcaaggagttcctgaatctgctggtgaatgccgcaggtagtaatgccaatctgctgatgaatattggcccgatgccgaatggtaaagttccgcagccgtttattaatagctttaaagaaatgggcgagtggattcgcgtttatggtgaaagcatttatggtacccgcggcggttatctgccgctgcagaaatggggcgcagtgacccagaaaagcggtaaaatttatgtgcatattctgaaaaacaacgagggtaaagccattaccctggaaaaatttccgtttaaaaagattaacagcgcatatctgctgaaagataaaaaaaccgtgaaatataccctgaaaaacaataccctgacctttgatagttatgccgttgatgatcagaatccggatgccgtgattgtgtttgaaggcaagagtacctggtctcatccgcagttcgagaaataa

SEQ ID NO: 182 - protein, 1269 aa, Artificial Sequence
  SYNTHETIC FUSION PROTEN
MGSSHHHHHHSSGLVPRGSHMEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQTIGVNELNGRTGLSKDYPDTPEGNKALAAAIVKAFVTDRGVDGLDIDIEHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKDGSGAFSQQKYQPTQANLKARTEFQDEKFGMFIHFGLYSELGRGEWVMNNDKIPVNDYAKLKDFFNPIGFNAKEYVSMAKNAGVKYITLVTRHHDGFSMWNTKYSDFNIMNTPFKRDLVKELANECHKQGVKIAFYYSLLDWTRTDYSYWTGRTGKGTGRTEKGNWNDYIQFMKNQLTELLTNYGEVSGIWFDGYWDQMEEEKAGRSEKTYIDWKMPEIYELIHKLQPQCLVGNNHHITPLEGEDFQMFERDIPGQNEHGLSFQKPSQLPLETCATLNDSWGFDLKDNKNKTFKEFLNLLVNAAGSNANLLMNIGPMPNGKVPQPFINSFKEMGEWIRVYGESIYGTRGGYLPLQKWGAVTQKSGKIYVHILKNNEGKAITLEKFPFKKINSAYLLKDKKTVKYTLKNNTLTFDSYAVDDQNPDAVIVFEGKSTWSHPQFEK

SEQ ID NO: 183 - DNA, 3810 bp, Artificial Sequence
  SYNTHETIC FUSION PROTEN
atgggcagcagccatcatcatcatcatcacagcagcggcctggtgccgcgcggcagccatatggaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcaggaaattggtgttaacgaattaaatggacgtacaggtttatctaaagattatcctgatactcctgaggggaacaaagctttagcagcagccattgtcaaggcatttgtaactgatcgtggtgtcgatggactagatattgatattgagcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggatggatccggtgcttttagtcagcagaaatatcagccgacccaggcaaatctgaaagcacgtaccgaatttcaggatgaaaaatttggtatgttcatccatttcggcctgtatagcgaactgggtcgtggcgaatgggttatgaataatgataaaattccggttaacgactacgcaaaactgaaagatttttttaacccgattggctttaacgcaaaagaatatgtgagcatggcaaaaaatgcaggtgttaaatatatcaccctggtgacccgtcatcatgatggttttagcatgtggaataccaaatatagcgattttaacatcatgaacaccccgtttaaacgcgatctggttaaagaactggcaaatgaatgccataaacagggcgtgaaaattgccttttattatagcctgctggattggacccgtaccgattatagttattggaccggccgcaccggtaaaggtaccggccgtaccgaaaaaggtaattggaatgattatatccagttcatgaagaatcagctgaccgaactgctgaccaattatggcgaagttagcggtatttggtttgatggctattgggatcagatggaagaagaaaaagccggtcgtagtgaaaaaacctatattgattggaaaatgccggaaatttacgaactgattcataaactgcagccgcagtgtctggtgggtaataatcatcatattaccccgctggaaggcgaagattttcagatgtttgaacgcgatattccgggccagaatgaacatggtctgagttttcagaaaccgagccagctgccgctggaaacctgcgcaaccctgaatgatagttggggctttgatctgaaagataataaaaataagaccttcaaggagttcctgaatctgctggtgaatgccgcaggtagtaatgccaatctgctgatgaatattggcccgatgccgaatggtaaagttccgcagccgtttattaatagctttaaagaaatgggcgagtggattcgcgtttatggtgaaagcatttatggtacccgcggcggttatctgccgctgcagaaatggggcgcagtgacccagaaaagcggtaaaatttatgtgcatattctgaaaaacaacgagggtaaagccattaccctggaaaaatttccgtttaaaaagattaacagcgcatatctgctgaaagataaaaaaaccgtgaaatataccctgaaaaacaataccctgacctttgatagttatgccgttgatgatcagaatccggatgccgtgattgtgtttgaaggcaagagtacctggtctcatccgcagttcgagaaataa

SEQ ID NO: 184 - protein, 1269 aa, Artificial Sequence
  SYNTHETIC FUSION PROTEN
MGSSHHHHHHSSGLVPRGSHMEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQEIGVNELNGRTGLSKDYPDTPEGNKALAAAIVKAFVTDRGVDGLDIDIEHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKDGSGAFSQQKYQPTQANLKARTEFQDEKFGMFIHFGLYSELGRGEWVMNNDKIPVNDYAKLKDFFNPIGFNAKEYVSMAKNAGVKYITLVTRHHDGFSMWNTKYSDFNIMNTPFKRDLVKELANECHKQGVKIAFYYSLLDWTRTDYSYWTGRTGKGTGRTEKGNWNDYIQFMKNQLTELLTNYGEVSGIWFDGYWDQMEEEKAGRSEKTYIDWKMPEIYELIHKLQPQCLVGNNHHITPLEGEDFQMFERDIPGQNEHGLSFQKPSQLPLETCATLNDSWGFDLKDNKNKTFKEFLNLLVNAAGSNANLLMNIGPMPNGKVPQPFINSFKEMGEWIRVYGESIYGTRGGYLPLQKWGAVTQKSGKIYVHILKNNEGKAITLEKFPFKKINSAYLLKDKKTVKYTLKNNTLTFDSYAVDDQNPDAVIVFEGKSTWSHPQFEK

SEQ ID NO: 185 - DNA, 3810 bp, Artificial Sequence
  SYNTHETIC FUSION PROTEN
atgggcagcagccatcatcatcatcatcacagcagcggcctggtgccgcgcggcagccatatggaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcagatgattggtgttaacgaattaaatggacgtacaggtttatctaaagattatcctgatactcctgaggggaacaaagctttagcagcagccattgtcaaggcatttgtaactgatcgtggtgtcgatggactagatattgatattgagcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggatggatccggtgcttttagtcagcagaaatatcagccgacccaggcaaatctgaaagcacgtaccgaatttcaggatgaaaaatttggtatgttcatccatttcggcctgtatagcgaactgggtcgtggcgaatgggttatgaataatgataaaattccggttaacgactacgcaaaactgaaagatttttttaacccgattggctttaacgcaaaagaatatgtgagcatggcaaaaaatgcaggtgttaaatatatcaccctggtgacccgtcatcatgatggttttagcatgtggaataccaaatatagcgattttaacatcatgaacaccccgtttaaacgcgatctggttaaagaactggcaaatgaatgccataaacagggcgtgaaaattgccttttattatagcctgctggattggacccgtaccgattatagttattggaccggccgcaccggtaaaggtaccggccgtaccgaaaaaggtaattggaatgattatatccagttcatgaagaatcagctgaccgaactgctgaccaattatggcgaagttagcggtatttggtttgatggctattgggatcagatggaagaagaaaaagccggtcgtagtgaaaaaacctatattgattggaaaatgccggaaatttacgaactgattcataaactgcagccgcagtgtctggtgggtaataatcatcatattaccccgctggaaggcgaagattttcagatgtttgaacgcgatattccgggccagaatgaacatggtctgagttttcagaaaccgagccagctgccgctggaaacctgcgcaaccctgaatgatagttggggctttgatctgaaagataataaaaataagaccttcaaggagttcctgaatctgctggtgaatgccgcaggtagtaatgccaatctgctgatgaatattggcccgatgccgaatggtaaagttccgcagccgtttattaatagctttaaagaaatgggcgagtggattcgcgtttatggtgaaagcatttatggtacccgcggcggttatctgccgctgcagaaatggggcgcagtgacccagaaaagcggtaaaatttatgtgcatattctgaaaaacaacgagggtaaagccattaccctggaaaaatttccgtttaaaaagattaacagcgcatatctgctgaaagataaaaaaaccgtgaaatataccctgaaaaacaataccctgacctttgatagttatgccgttgatgatcagaatccggatgccgtgattgtgtttgaaggcaagagtacctggtctcatccgcagttcgagaaataa

SEQ ID NO: 186 - protein, 1269 aa, Artificial Sequence
  SYNTHETIC FUSION PROTEN
MGSSHHHHHHSSGLVPRGSHMEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQMIGVNELNGRTGLSKDYPDTPEGNKALAAAIVKAFVTDRGVDGLDIDIEHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKDGSGAFSQQKYQPTQANLKARTEFQDEKFGMFIHFGLYSELGRGEWVMNNDKIPVNDYAKLKDFFNPIGFNAKEYVSMAKNAGVKYITLVTRHHDGFSMWNTKYSDFNIMNTPFKRDLVKELANECHKQGVKIAFYYSLLDWTRTDYSYWTGRTGKGTGRTEKGNWNDYIQFMKNQLTELLTNYGEVSGIWFDGYWDQMEEEKAGRSEKTYIDWKMPEIYELIHKLQPQCLVGNNHHITPLEGEDFQMFERDIPGQNEHGLSFQKPSQLPLETCATLNDSWGFDLKDNKNKTFKEFLNLLVNAAGSNANLLMNIGPMPNGKVPQPFINSFKEMGEWIRVYGESIYGTRGGYLPLQKWGAVTQKSGKIYVHILKNNEGKAITLEKFPFKKINSAYLLKDKKTVKYTLKNNTLTFDSYAVDDQNPDAVIVFEGKSTWSHPQFEK

SEQ ID NO: 187 - DNA, 3810 bp, Artificial Sequence
  SYNTHETIC FUSION PROTEN
atgggcagcagccatcatcatcatcatcacagcagcggcctggtgccgcgcggcagccatatggaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcagacaattggtgttaacgaattaaatggacgtacaggtttatctaaagattatcctgatactcctgaggggaacaaagctttagcagcagccattgtcaaggcatttgtaactgatcgtggtgtcgatggactagatattatgattgagcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggatggatccggtgcttttagtcagcagaaatatcagccgacccaggcaaatctgaaagcacgtaccgaatttcaggatgaaaaatttggtatgttcatccatttcggcctgtatagcgaactgggtcgtggcgaatgggttatgaataatgataaaattccggttaacgactacgcaaaactgaaagatttttttaacccgattggctttaacgcaaaagaatatgtgagcatggcaaaaaatgcaggtgttaaatatatcaccctggtgacccgtcatcatgatggttttagcatgtggaataccaaatatagcgattttaacatcatgaacaccccgtttaaacgcgatctggttaaagaactggcaaatgaatgccataaacagggcgtgaaaattgccttttattatagcctgctggattggacccgtaccgattatagttattggaccggccgcaccggtaaaggtaccggccgtaccgaaaaaggtaattggaatgattatatccagttcatgaagaatcagctgaccgaactgctgaccaattatggcgaagttagcggtatttggtttgatggctattgggatcagatggaagaagaaaaagccggtcgtagtgaaaaaacctatattgattggaaaatgccggaaatttacgaactgattcataaactgcagccgcagtgtctggtgggtaataatcatcatattaccccgctggaaggcgaagattttcagatgtttgaacgcgatattccgggccagaatgaacatggtctgagttttcagaaaccgagccagctgccgctggaaacctgcgcaaccctgaatgatagttggggctttgatctgaaagataataaaaataagaccttcaaggagttcctgaatctgctggtgaatgccgcaggtagtaatgccaatctgctgatgaatattggcccgatgccgaatggtaaagttccgcagccgtttattaatagctttaaagaaatgggcgagtggattcgcgtttatggtgaaagcatttatggtacccgcggcggttatctgccgctgcagaaatggggcgcagtgacccagaaaagcggtaaaatttatgtgcatattctgaaaaacaacgagggtaaagccattaccctggaaaaatttccgtttaaaaagattaacagcgcatatctgctgaaagataaaaaaaccgtgaaatataccctgaaaaacaataccctgacctttgatagttatgccgttgatgatcagaatccggatgccgtgattgtgtttgaaggcaagagtacctggtctcatccgcagttcgagaaataa

SEQ ID NO: 188 - protein, 1269 aa, Artificial Sequence
  SYNTHETIC FUSION PROTEN
MGSSHHHHHHSSGLVPRGSHMEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQTIGVNELNGRTGLSKDYPDTPEGNKALAAAIVKAFVTDRGVDGLDIMIEHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKDGSGAFSQQKYQPTQANLKARTEFQDEKFGMFIHFGLYSELGRGEWVMNNDKIPVNDYAKLKDFFNPIGFNAKEYVSMAKNAGVKYITLVTRHHDGFSMWNTKYSDFNIMNTPFKRDLVKELANECHKQGVKIAFYYSLLDWTRTDYSYWTGRTGKGTGRTEKGNWNDYIQFMKNQLTELLTNYGEVSGIWFDGYWDQMEEEKAGRSEKTYIDWKMPEIYELIHKLQPQCLVGNNHHITPLEGEDFQMFERDIPGQNEHGLSFQKPSQLPLETCATLNDSWGFDLKDNKNKTFKEFLNLLVNAAGSNANLLMNIGPMPNGKVPQPFINSFKEMGEWIRVYGESIYGTRGGYLPLQKWGAVTQKSGKIYVHILKNNEGKAITLEKFPFKKINSAYLLKDKKTVKYTLKNNTLTFDSYAVDDQNPDAVIVFEGKSTWSHPQFEK

SEQ ID NO: 189 - DNA, 3003 bp, Artificial Sequence
  SYNTHETIC FUSION PROTEN
atgggcagcagccatcatcatcatcatcacagcagcggcctggtgccgcgcggcagccatatgtttagtcagcagaaatatcagccgacccaggcaaatctgaaagcacgtaccgaatttcaggatgaaaaatttggtatgttcatccatttcggcctgtatagcgaactgggtcgtggcgaatgggttatgaataatgataaaattccggttaacgactacgcaaaactgaaagatttttttaacccgattggctttaacgcaaaagaatatgtgagcatggcaaaaaatgcaggtgttaaatatatcaccctggtgacccgtcatcatgatggttttagcatgtggaataccaaatatagcgattttaacatcatgaacaccccgtttaaacgcgatctggttaaagaactggcaaatgaatgccataaacagggcgtgaaaattgccttttattatagcctgctggattggacccgtaccgattatagttattggaccggccgcaccggtaaaggtaccggccgtaccgaaaaaggtaattggaatgattatatccagttcatgaagaatcagctgaccgaactgctgaccaattatggcgaagttagcggtatttggtttgatggctattgggatcagatggaagaagaaaaagccggtcgtagtgaaaaaacctatattgattggaaaatgccggaaatttacgaactgattcataaactgcagccgcagtgtctggtgggtaataatcatcatattaccccgctggaaggcgaagattttcagatgtttgaacgcgatattccgggccagaatgaacatggtctgagttttcagaaaccgagccagctgccgctggaaacctgcgcaaccctgaatgatagttggggctttgatctgaaagataataaaaataagaccttcaaggagttcctgaatctgctggtgaatgccgcaggtagtaatgccaatctgctgatgaatattggcccgatgccgaatggtaaagttccgcagccgtttattaatagctttaaagaaatgggcgagtggattcgcgtttatggtgaaagcatttatggtacccgcggcggttatctgccgctgcagaaatggggcgcagtgacccagaaaagcggtaaaatttatgtgcatattctgaaaaacaacgagggtaaagccattaccctggaaaaatttccgtttaaaaagattaacagcgcatatctgctgaaagataaaaaaaccgtgaaatataccctgaaaaacaataccctgacctttgatagttatgccgttgatgatcagaatccggatgccgtgattgtgtttgaaggcaagggatccaaagataagtcgtatgatctgattgatgagaaagatttcccagataaggctttgcgagaagctgtgatggcgcaggttggaaccagaaaaggtgatttggaacgtttcaatggcacattacgattggataatccagcgattcaaagtttagaaggtctaaataaatttaaaaaattagctcaattagacttgattggcttatctcgcattacaaagctcgaccgttctgttttacccgctaatatgaagccaggcaaagataccttggaaacagttcttgaaacctataaaaaggataacaaagaagaacctgctactatcccaccagtatctttgaaggtttctggtttaactggtctgaaagaattagatttgtcaggttttgaccgtgaaaccttggctggtcttgatgccgctactctaacgtctttagaaaaagttgatatttctggcaacaaacttgatttggctccaggaacagaaaatcgacaaatttttgatactatgctatcaactatcagcaatcatgttggaagcaatgaacaaacagtgaaatttgacaagcaaaaaccaactgggcattacccagatacctatgggaaaactagtctgcgcttaccagtggcaaatgaaaaagttgatttgcaaagccagcttttgtttgggactgtgacaaatcaaggaaccctaatcaatagcgaagcagactataaggcttaccaaaatcataaaattgctggacgtagctttgttgattcaaactatcattacaataactttaaagtttcttatgagaactataccgttaaagtaactgattccacattgggaaccactactgacaaaacgctagcaactgataaagaagagacctataaggttgacttctttagcccagcagataagacaaaagctgttcatactgctaaagtgattgttggtgacgaaaaaaccatgatggttaatttggcagaaggcgcaacagttattggaggaagtgctgatcctgtaaatgcaagaaaggtatttgatgggcaactgggcagtgagactgataatatctctttaggatgggattctaagcaaagtattatatttaaattgaaagaagatggattaataaagcattggcgtttcttcaatgattcagcccgaaatcctgagacaaccaataaacctattcaggaagcaagtctacaaatttttaatatcaaagattataatctagataatttgttggaaaatcccaataaatttgatgatgaaaaatattggattactgtagatacttacagtgcacaaggagagagagctactgcattcagtaatacattaaataatattactagtaaatattggcgagttgtctttgatactaaaggagatagatatagttcgccagtagtccctgaactccaaattttaggttatccgttacctaacgccgacactatcatgaaaacagtaactactgctaaagagttatctcaacaaaaagataagttttctcaaaagatgcttgatgagttaaaaataaaagagatggctttagaaacttctttgaacagtaagatttttgatgtaactgctattaatgctaatgctggagttttgaaagattgtattgagaaaaggcagctgctaaaaaaataa

SEQ ID NO: 190 - protein, 1000 aa, Artificial Sequence
  SYNTHETIC FUSION PROTEN
MGSSHHHHHHSSGLVPRGSHMFSQQKYQPTQANLKARTEFQDEKFGMFIHFGLYSELGRGEWVMNNDKIPVNDYAKLKDFFNPIGFNAKEYVSMAKNAGVKYITLVTRHHDGFSMWNTKYSDFNIMNTPFKRDLVKELANECHKQGVKIAFYYSLLDWTRTDYSYWTGRTGKGTGRTEKGNWNDYIQFMKNQLTELLTNYGEVSGIWFDGYWDQMEEEKAGRSEKTYIDWKMPEIYELIHKLQPQCLVGNNHHITPLEGEDFQMFERDIPGQNEHGLSFQKPSQLPLETCATLNDSWGFDLKDNKNKTFKEFLNLLVNAAGSNANLLMNIGPMPNGKVPQPFINSFKEMGEWIRVYGESIYGTRGGYLPLQKWGAVTQKSGKIYVHILKNNEGKAITLEKFPFKKINSAYLLKDKKTVKYTLKNNTLTFDSYAVDDQNPDAVIVFEGKGSKDKSYDLIDEKDFPDKALREAVMAQVGTRKGDLERFNGTLRLDNPAIQSLEGLNKFKKLAQLDLIGLSRITKLDRSVLPANMKPGKDTLETVLETYKKDNKEEPATIPPVSLKVSGLTGLKELDLSGFDRETLAGLDAATLTSLEKVDISGNKLDLAPGTENRQIFDTMLSTISNHVGSNEQTVKFDKQKPTGHYPDTYGKTSLRLPVANEKVDLQSQLLFGTVTNQGTLINSEADYKAYQNHKIAGRSFVDSNYHYNNFKVSYENYTVKVTDSTLGTTTDKTLATDKEETYKVDFFSPADKTKAVHTAKVIVGDEKTMMVNLAEGATVIGGSADPVNARKVFDGQLGSETDNISLGWDSKQSIIFKLKEDGLIKHWRFFNDSARNPETTNKPIQEASLQIFNIKDYNLDNLLENPNKFDDEKYWITVDTYSAQGERATAFSNTLNNITSKYWRVVFDTKGDRYSSPVVPELQILGYPLPNADTIMKTVTTAKELSQQKDKFSQKMLDELKIKEMALETSLNSKIFDVTAINANAGVLKDCIEKRQLLKK

SEQ ID NO: 191 - DNA, 2730 bp, Artificial Sequence
  SYNTHETIC FUSION PROTEN
atgggcagcagccatcatcatcatcatcacagcagcggcctggtgccgcgcggcagccatatgtttagtcagcagaaatatcagccgacccaggcaaatctgaaagcacgtaccgaatttcaggatgaaaaatttggtatgttcatccatttcggcctgtatagcgaactgggtcgtggcgaatgggttatgaataatgataaaattccggttaacgactacgcaaaactgaaagatttttttaacccgattggctttaacgcaaaagaatatgtgagcatggcaaaaaatgcaggtgttaaatatatcaccctggtgacccgtcatcatgatggttttagcatgtggaataccaaatatagcgattttaacatcatgaacaccccgtttaaacgcgatctggttaaagaactggcaaatgaatgccataaacagggcgtgaaaattgccttttattatagcctgctggattggacccgtaccgattatagttattggaccggccgcaccggtaaaggtaccggccgtaccgaaaaaggtaattggaatgattatatccagttcatgaagaatcagctgaccgaactgctgaccaattatggcgaagttagcggtatttggtttgatggctattgggatcagatggaagaagaaaaagccggtcgtagtgaaaaaacctatattgattggaaaatgccggaaatttacgaactgattcataaactgcagccgcagtgtctggtgggtaataatcatcatattaccccgctggaaggcgaagattttcagatgtttgaacgcgatattccgggccagaatgaacatggtctgagttttcagaaaccgagccagctgccgctggaaacctgcgcaaccctgaatgatagttggggctttgatctgaaagataataaaaataagaccttcaaggagttcctgaatctgctggtgaatgccgcaggtagtaatgccaatctgctgatgaatattggcccgatgccgaatggtaaagttccgcagccgtttattaatagctttaaagaaatgggcgagtggattcgcgtttatggtgaaagcatttatggtacccgcggcggttatctgccgctgcagaaatggggcgcagtgacccagaaaagcggtaaaatttatgtgcatattctgaaaaacaacgagggtaaagccattaccctggaaaaatttccgtttaaaaagattaacagcgcatatctgctgaaagataaaaaaaccgtgaaatataccctgaaaaacaataccctgacctttgatagttatgccgttgatgatcagaatccggatgccgtgattgtgtttgaaggcaagggatccaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggattaa

SEQ ID NO: 192 - protein, 909 aa, Artificial Sequence
  SYNTHETIC FUSION PROTEN
MGSSHHHHHHSSGLVPRGSHMFSQQKYQPTQANLKARTEFQDEKFGMFIHFGLYSELGRGEWVMNNDKIPVNDYAKLKDFFNPIGFNAKEYVSMAKNAGVKYITLVTRHHDGFSMWNTKYSDFNIMNTPFKRDLVKELANECHKQGVKIAFYYSLLDWTRTDYSYWTGRTGKGTGRTEKGNWNDYIQFMKNQLTELLTNYGEVSGIWFDGYWDQMEEEKAGRSEKTYIDWKMPEIYELIHKLQPQCLVGNNHHITPLEGEDFQMFERDIPGQNEHGLSFQKPSQLPLETCATLNDSWGFDLKDNKNKTFKEFLNLLVNAAGSNANLLMNIGPMPNGKVPQPFINSFKEMGEWIRVYGESIYGTRGGYLPLQKWGAVTQKSGKIYVHILKNNEGKAITLEKFPFKKINSAYLLKDKKTVKYTLKNNTLTFDSYAVDDQNPDAVIVFEGKGSTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKD

SEQ ID NO: 193 - DNA, 4263 bp, Artificial Sequence
  SYNTHETIC FUSION PROTEN
atgggcagcagccatcatcatcatcatcacagcagcggcctggtgccgcgcggcagccatatgtttagtcagcagaaatatcagccgacccaggcaaatctgaaagcacgtaccgaatttcaggatgaaaaatttggtatgttcatccatttcggcctgtatagcgaactgggtcgtggcgaatgggttatgaataatgataaaattccggttaacgactacgcaaaactgaaagatttttttaacccgattggctttaacgcaaaagaatatgtgagcatggcaaaaaatgcaggtgttaaatatatcaccctggtgacccgtcatcatgatggttttagcatgtggaataccaaatatagcgattttaacatcatgaacaccccgtttaaacgcgatctggttaaagaactggcaaatgaatgccataaacagggcgtgaaaattgccttttattatagcctgctggattggacccgtaccgattatagttattggaccggccgcaccggtaaaggtaccggccgtaccgaaaaaggtaattggaatgattatatccagttcatgaagaatcagctgaccgaactgctgaccaattatggcgaagttagcggtatttggtttgatggctattgggatcagatggaagaagaaaaagccggtcgtagtgaaaaaacctatattgattggaaaatgccggaaatttacgaactgattcataaactgcagccgcagtgtctggtgggtaataatcatcatattaccccgctggaaggcgaagattttcagatgtttgaacgcgatattccgggccagaatgaacatggtctgagttttcagaaaccgagccagctgccgctggaaacctgcgcaaccctgaatgatagttggggctttgatctgaaagataataaaaataagaccttcaaggagttcctgaatctgctggtgaatgccgcaggtagtaatgccaatctgctgatgaatattggcccgatgccgaatggtaaagttccgcagccgtttattaatagctttaaagaaatgggcgagtggattcgcgtttatggtgaaagcatttatggtacccgcggcggttatctgccgctgcagaaatggggcgcagtgacccagaaaagcggtaaaatttatgtgcatattctgaaaaacaacgagggtaaagccattaccctggaaaaatttccgtttaaaaagattaacagcgcatatctgctgaaagataaaaaaaccgtgaaatataccctgaaaaacaataccctgacctttgatagttatgccgttgatgatcagaatccggatgccgtgattgtgtttgaaggcaagggatccacccaccatgattcactcaatactgtaaaagcggaggagaagactgttcaggttcagaaaggattaccttctatcgatagcttgcattatctgtcagagaatagcaaaaaagaatttaaagaagaactctcaaaagcggggcaagaatctcaaaaggtcaaagagatattagcaaaagctcagcaggcagataaacaagctcaagaacttgccaaaatgaaaattcctgagaaaataccgatgaaaccgttacatggttctctctacggtggttactttagaacttggcatgacaaaacatcagatccaacagaaaaagacaaagttaactcgatgggagagcttcctaaagaagtagatctagcctttattttccacgattggacaaaagattatagccttttttggaaagaattggccaccaaacatgtgccaaagttaaacaagcaagggacacgtgtcattcgtaccattccatggcgtttcctagctgggggtgataacagtggtattgcagaagataccagtaaatacccaaatacaccagagggaaataaagctttagccaaagctattgttgatgaatatgtttataaatacaaccttgatggcttagatgtggatgttgaacatgatagtattccaaaagttgacaaaaaagaagatacagcaggcgtagaacgctctattcaagtgtttgaagaaattgggaaattaattggaccaaaaggtgttgataaatcgcggttatttattatggatagcacctacatggctgataaaaacccattgattgagcgaggagctccttatattaatttattactggtacaggtctatggttcacaaggagagaaaggtggttgggagcctgtttctaatcgacctgaaaaaacaatggaagaacgatggcaaggttatagcaagtatattcgtcctgaacaatacatgattggtttttctttctatgaggaaaatgctcaagaagggaatctttggtatgatattaattctcgcaaggacgaggacaaagcaaatggaattaacactgacataactggaacgcgtgccgaacggtatgcaaggtggcaacctaagacaggtggggttaagggaggtatcttctcctacgctattgaccgagatggtgtagctcatcaacctaaaaaatatgctaaacagaaagagtttaaggacgcaactgataacatcttccactcagattatagtgtctccaaggcattaaagacagttatgctaaaagataagtcgtatgatctgattgatgagaaagatttcccagataaggctttgcgagaagctgtgatggcgcaggttggaaccagaaaaggtgatttggaacgtttcaatggcacattacgattggataatccagcgattcaaagtttagaaggtctaaataaatttaaaaaattagctcaattagacttgattggcttatctcgcattacaaagctcgaccgttctgttttacccgctaatatgaagccaggcaaagataccttggaaacagttcttgaaacctataaaaaggataacaaagaagaacctgctactatcccaccagtatctttgaaggtttctggtttaactggtctgaaagaattagatttgtcaggttttgaccgtgaaaccttggctggtcttgatgccgctactctaacgtctttagaaaaagttgatatttctggcaacaaacttgatttggctccaggaacagaaaatcgacaaatttttgatactatgctatcaactatcagcaatcatgttggaagcaatgaacaaacagtgaaatttgacaagcaaaaaccaactgggcattacccagatacctatgggaaaactagtctgcgcttaccagtggcaaatgaaaaagttgatttgcaaagccagcttttgtttgggactgtgacaaatcaaggaaccctaatcaatagcgaagcagactataaggcttaccaaaatcataaaattgctggacgtagctttgttgattcaaactatcattacaataactttaaagtttcttatgagaactataccgttaaagtaactgattccacattgggaaccactactgacaaaacgctagcaactgataaagaagagacctataaggttgacttctttagcccagcagataagacaaaagctgttcatactgctaaagtgattgttggtgacgaaaaaaccatgatggttaatttggcagaaggcgcaacagttattggaggaagtgctgatcctgtaaatgcaagaaaggtatttgatgggcaactgggcagtgagactgataatatctctttaggatgggattctaagcaaagtattatatttaaattgaaagaagatggattaataaagcattggcgtttcttcaatgattcagcccgaaatcctgagacaaccaataaacctattcaggaagcaagtctacaaatttttaatatcaaagattataatctagataatttgttggaaaatcccaataaatttgatgatgaaaaatattggattactgtagatacttacagtgcacaaggagagagagctactgcattcagtaatacattaaataatattactagtaaatattggcgagttgtctttgatactaaaggagatagatatagttcgccagtagtccctgaactccaaattttaggttatccgttacctaacgccgacactatcatgaaaacagtaactactgctaaagagttatctcaacaaaaagataagttttctcaaaagatgcttgatgagttaaaaataaaagagatggctttagaaacttctttgaacagtaagatttttgatgtaactgctattaatgctaatgctggagttttgaaagattgtattgagaaaaggcagctgctaaaaaaataa

SEQ ID NO: 194 - protein, 1420 aa, Artificial Sequence
  SYNTHETIC FUSION PROTEN
MGSSHHHHHHSSGLVPRGSHMFSQQKYQPTQANLKARTEFQDEKFGMFIHFGLYSELGRGEWVMNNDKIPVNDYAKLKDFFNPIGFNAKEYVSMAKNAGVKYITLVTRHHDGFSMWNTKYSDFNIMNTPFKRDLVKELANECHKQGVKIAFYYSLLDWTRTDYSYWTGRTGKGTGRTEKGNWNDYIQFMKNQLTELLTNYGEVSGIWFDGYWDQMEEEKAGRSEKTYIDWKMPEIYELIHKLQPQCLVGNNHHITPLEGEDFQMFERDIPGQNEHGLSFQKPSQLPLETCATLNDSWGFDLKDNKNKTFKEFLNLLVNAAGSNANLLMNIGPMPNGKVPQPFINSFKEMGEWIRVYGESIYGTRGGYLPLQKWGAVTQKSGKIYVHILKNNEGKAITLEKFPFKKINSAYLLKDKKTVKYTLKNNTLTFDSYAVDDQNPDAVIVFEGKGSTHHDSLNTVKAEEKTVQVQKGLPSIDSLHYLSENSKKEFKEELSKAGQESQKVKEILAKAQQADKQAQELAKMKIPEKIPMKPLHGSLYGGYFRTWHDKTSDPTEKDKVNSMGELPKEVDLAFIFHDWTKDYSLFWKELATKHVPKLNKQGTRVIRTIPWRFLAGGDNSGIAEDTSKYPNTPEGNKALAKAIVDEYVYKYNLDGLDVDVEHDSIPKVDKKEDTAGVERSIQVFEEIGKLIGPKGVDKSRLFIMDSTYMADKNPLIERGAPYINLLLVQVYGSQGEKGGWEPVSNRPEKTMEERWQGYSKYIRPEQYMIGFSFYEENAQEGNLWYDINSRKDEDKANGINTDITGTRAERYARWQPKTGGVKGGIFSYAIDRDGVAHQPKKYAKQKEFKDATDNIFHSDYSVSKALKTVMLKDKSYDLIDEKDFPDKALREAVMAQVGTRKGDLERFNGTLRLDNPAIQSLEGLNKFKKLAQLDLIGLSRITKLDRSVLPANMKPGKDTLETVLETYKKDNKEEPATIPPVSLKVSGLTGLKELDLSGFDRETLAGLDAATLTSLEKVDISGNKLDLAPGTENRQIFDTMLSTISNHVGSNEQTVKFDKQKPTGHYPDTYGKTSLRLPVANEKVDLQSQLLFGTVTNQGTLINSEADYKAYQNHKIAGRSFVDSNYHYNNFKVSYENYTVKVTDSTLGTTTDKTLATDKEETYKVDFFSPADKTKAVHTAKVIVGDEKTMMVNLAEGATVIGGSADPVNARKVFDGQLGSETDNISLGWDSKQSIIFKLKEDGLIKHWRFFNDSARNPETTNKPIQEASLQIFNIKDYNLDNLLENPNKFDDEKYWITVDTYSAQGERATAFSNTLNNITSKYWRVVFDTKGDRYSSPVVPELQILGYPLPNADTIMKTVTTAKELSQQKDKFSQKMLDELKIKEMALETSLNSKIFDVTAINANAGVLKDCIEKRQLLKK

SEQ ID NO: 195 - DNA, 4263 bp, Artificial Sequence
  SYNTHETIC FUSION PROTEN
atgggcagcagccatcatcatcatcatcacagcagcggcctggtgccgcgcggcagccatatgtttagtcagcagaaatatcagccgacccaggcaaatctgaaagcacgtaccgaatttcaggatgaaaaatttggtatgttcatccatttcggcctgtatagcgaactgggtcgtggcgaatgggttatgaataatgataaaattccggttaacgactacgcaaaactgaaagatttttttaacccgattggctttaacgcaaaagaatatgtgagcatggcaaaaaatgcaggtgttaaatatatcaccctggtgacccgtcatcatgatggttttagcatgtggaataccaaatatagcgattttaacatcatgaacaccccgtttaaacgcgatctggttaaagaactggcaaatgaatgccataaacagggcgtgaaaattgccttttattatagcctgctggattggacccgtaccgattatagttattggaccggccgcaccggtaaaggtaccggccgtaccgaaaaaggtaattggaatgattatatccagttcatgaagaatcagctgaccgaactgctgaccaattatggcgaagttagcggtatttggtttgatggctattgggatcagatggaagaagaaaaagccggtcgtagtgaaaaaacctatattgattggaaaatgccggaaatttacgaactgattcataaactgcagccgcagtgtctggtgggtaataatcatcatattaccccgctggaaggcgaagattttcagatgtttgaacgcgatattccgggccagaatgaacatggtctgagttttcagaaaccgagccagctgccgctggaaacctgcgcaaccctgaatgatagttggggctttgatctgaaagataataaaaataagaccttcaaggagttcctgaatctgctggtgaatgccgcaggtagtaatgccaatctgctgatgaatattggcccgatgccgaatggtaaagttccgcagccgtttattaatagctttaaagaaatgggcgagtggattcgcgtttatggtgaaagcatttatggtacccgcggcggttatctgccgctgcagaaatggggcgcagtgacccagaaaagcggtaaaatttatgtgcatattctgaaaaacaacgagggtaaagccattaccctggaaaaatttccgtttaaaaagattaacagcgcatatctgctgaaagataaaaaaaccgtgaaatataccctgaaaaacaataccctgacctttgatagttatgccgttgatgatcagaatccggatgccgtgattgtgtttgaaggcaagggatccacccaccatgattcactcaatactgtaaaagcggaggagaagactgttcaggttcagaaaggattaccttctatcgatagcttgcattatctgtcagagaatagcaaaaaagaatttaaagaagaactctcaaaagcggggcaagaatctcaaaaggtcaaagagatattagcaaaagctcagcaggcagataaacaagctcaagaacttgccaaaatgaaaattcctgagaaaataccgatgaaaccgttacatggttctctctacggtggttactttagaacttggcatgacaaaacatcagatccaacagaaaaagacaaagttaactcgatgggagagcttcctaaagaagtagatctagcctttattttccacgattggacaaaagattatagccttttttggaaagaattggccaccaaacatgtgccaaagttaaacaagcaagggacacgtgtcattcgtaccattccatggcgtttcctagctgggggtgataacagtggtattgcagaagataccagtaaatacccaaatacaccagagggaaataaagctttagccaaagctattgttgatgaatatgtttataaatacaaccttgatggcttagatgtgcaggttgaacatgatagtattccaaaagttgacaaaaaagaagatacagcaggcgtagaacgctctattcaagtgtttgaagaaattgggaaattaattggaccaaaaggtgttgataaatcgcggttatttattatggatagcacctacatggctgataaaaacccattgattgagcgaggagctccttatattaatttattactggtacaggtctatggttcacaaggagagaaaggtggttgggagcctgtttctaatcgacctgaaaaaacaatggaagaacgatggcaaggttatagcaagtatattcgtcctgaacaatacatgattggtttttctttctatgaggaaaatgctcaagaagggaatctttggtatgatattaattctcgcaaggacgaggacaaagcaaatggaattaacactgacataactggaacgcgtgccgaacggtatgcaaggtggcaacctaagacaggtggggttaagggaggtatcttctcctacgctattgaccgagatggtgtagctcatcaacctaaaaaatatgctaaacagaaagagtttaaggacgcaactgataacatcttccactcagattatagtgtctccaaggcattaaagacagttatgctaaaagataagtcgtatgatctgattgatgagaaagatttcccagataaggctttgcgagaagctgtgatggcgcaggttggaaccagaaaaggtgatttggaacgtttcaatggcacattacgattggataatccagcgattcaaagtttagaaggtctaaataaatttaaaaaattagctcaattagacttgattggcttatctcgcattacaaagctcgaccgttctgttttacccgctaatatgaagccaggcaaagataccttggaaacagttcttgaaacctataaaaaggataacaaagaagaacctgctactatcccaccagtatctttgaaggtttctggtttaactggtctgaaagaattagatttgtcaggttttgaccgtgaaaccttggctggtcttgatgccgctactctaacgtctttagaaaaagttgatatttctggcaacaaacttgatttggctccaggaacagaaaatcgacaaatttttgatactatgctatcaactatcagcaatcatgttggaagcaatgaacaaacagtgaaatttgacaagcaaaaaccaactgggcattacccagatacctatgggaaaactagtctgcgcttaccagtggcaaatgaaaaagttgatttgcaaagccagcttttgtttgggactgtgacaaatcaaggaaccctaatcaatagcgaagcagactataaggcttaccaaaatcataaaattgctggacgtagctttgttgattcaaactatcattacaataactttaaagtttcttatgagaactataccgttaaagtaactgattccacattgggaaccactactgacaaaacgctagcaactgataaagaagagacctataaggttgacttctttagcccagcagataagacaaaagctgttcatactgctaaagtgattgttggtgacgaaaaaaccatgatggttaatttggcagaaggcgcaacagttattggaggaagtgctgatcctgtaaatgcaagaaaggtatttgatgggcaactgggcagtgagactgataatatctctttaggatgggattctaagcaaagtattatatttaaattgaaagaagatggattaataaagcattggcgtttcttcaatgattcagcccgaaatcctgagacaaccaataaacctattcaggaagcaagtctacaaatttttaatatcaaagattataatctagataatttgttggaaaatcccaataaatttgatgatgaaaaatattggattactgtagatacttacagtgcacaaggagagagagctactgcattcagtaatacattaaataatattactagtaaatattggcgagttgtctttgatactaaaggagatagatatagttcgccagtagtccctgaactccaaattttaggttatccgttacctaacgccgacactatcatgaaaacagtaactactgctaaagagttatctcaacaaaaagataagttttctcaaaagatgcttgatgagttaaaaataaaagagatggctttagaaacttctttgaacagtaagatttttgatgtaactgctattaatgctaatgctggagttttgaaagattgtattgagaaaaggcagctgctaaaaaaataa

SEQ ID NO: 196 - protein, 1420 aa, Artificial Sequence
  SYNTHETIC FUSION PROTEN
MGSSHHHHHHSSGLVPRGSHMFSQQKYQPTQANLKARTEFQDEKFGMFIHFGLYSELGRGEWVMNNDKIPVNDYAKLKDFFNPIGFNAKEYVSMAKNAGVKYITLVTRHHDGFSMWNTKYSDFNIMNTPFKRDLVKELANECHKQGVKIAFYYSLLDWTRTDYSYWTGRTGKGTGRTEKGNWNDYIQFMKNQLTELLTNYGEVSGIWFDGYWDQMEEEKAGRSEKTYIDWKMPEIYELIHKLQPQCLVGNNHHITPLEGEDFQMFERDIPGQNEHGLSFQKPSQLPLETCATLNDSWGFDLKDNKNKTFKEFLNLLVNAAGSNANLLMNIGPMPNGKVPQPFINSFKEMGEWIRVYGESIYGTRGGYLPLQKWGAVTQKSGKIYVHILKNNEGKAITLEKFPFKKINSAYLLKDKKTVKYTLKNNTLTFDSYAVDDQNPDAVIVFEGKGSTHHDSLNTVKAEEKTVQVQKGLPSIDSLHYLSENSKKEFKEELSKAGQESQKVKEILAKAQQADKQAQELAKMKIPEKIPMKPLHGSLYGGYFRTWHDKTSDPTEKDKVNSMGELPKEVDLAFIFHDWTKDYSLFWKELATKHVPKLNKQGTRVIRTIPWRFLAGGDNSGIAEDTSKYPNTPEGNKALAKAIVDEYVYKYNLDGLDVQVEHDSIPKVDKKEDTAGVERSIQVFEEIGKLIGPKGVDKSRLFIMDSTYMADKNPLIERGAPYINLLLVQVYGSQGEKGGWEPVSNRPEKTMEERWQGYSKYIRPEQYMIGFSFYEENAQEGNLWYDINSRKDEDKANGINTDITGTRAERYARWQPKTGGVKGGIFSYAIDRDGVAHQPKKYAKQKEFKDATDNIFHSDYSVSKALKTVMLKDKSYDLIDEKDFPDKALREAVMAQVGTRKGDLERFNGTLRLDNPAIQSLEGLNKFKKLAQLDLIGLSRITKLDRSVLPANMKPGKDTLETVLETYKKDNKEEPATIPPVSLKVSGLTGLKELDLSGFDRETLAGLDAATLTSLEKVDISGNKLDLAPGTENRQIFDTMLSTISNHVGSNEQTVKFDKQKPTGHYPDTYGKTSLRLPVANEKVDLQSQLLFGTVTNQGTLINSEADYKAYQNHKIAGRSFVDSNYHYNNFKVSYENYTVKVTDSTLGTTTDKTLATDKEETYKVDFFSPADKTKAVHTAKVIVGDEKTMMVNLAEGATVIGGSADPVNARKVFDGQLGSETDNISLGWDSKQSIIFKLKEDGLIKHWRFFNDSARNPETTNKPIQEASLQIFNIKDYNLDNLLENPNKFDDEKYWITVDTYSAQGERATAFSNTLNNITSKYWRVVFDTKGDRYSSPVVPELQILGYPLPNADTIMKTVTTAKELSQQKDKFSQKMLDELKIKEMALETSLNSKIFDVTAINANAGVLKDCIEKRQLLKK

SEQ ID NO: 197 - DNA, 3774 bp, Artificial Sequence
  SYNTHETIC FUSION PROTEN
atgggcagcagccatcatcatcatcatcacagcagcggcctggtgccgcgcggcagccatatgtttagtcagcagaaatatcagccgacccaggcaaatctgaaagcacgtaccgaatttcaggatgaaaaatttggtatgttcatccatttcggcctgtatagcgaactgggtcgtggcgaatgggttatgaataatgataaaattccggttaacgactacgcaaaactgaaagatttttttaacccgattggctttaacgcaaaagaatatgtgagcatggcaaaaaatgcaggtgttaaatatatcaccctggtgacccgtcatcatgatggttttagcatgtggaataccaaatatagcgattttaacatcatgaacaccccgtttaaacgcgatctggttaaagaactggcaaatgaatgccataaacagggcgtgaaaattgccttttattatagcctgctggattggacccgtaccgattatagttattggaccggccgcaccggtaaaggtaccggccgtaccgaaaaaggtaattggaatgattatatccagttcatgaagaatcagctgaccgaactgctgaccaattatggcgaagttagcggtatttggtttgatggctattgggatcagatggaagaagaaaaagccggtcgtagtgaaaaaacctatattgattggaaaatgccggaaatttacgaactgattcataaactgcagccgcagtgtctggtgggtaataatcatcatattaccccgctggaaggcgaagattttcagatgtttgaacgcgatattccgggccagaatgaacatggtctgagttttcagaaaccgagccagctgccgctggaaacctgcgcaaccctgaatgatagttggggctttgatctgaaagataataaaaataagaccttcaaggagttcctgaatctgctggtgaatgccgcaggtagtaatgccaatctgctgatgaatattggcccgatgccgaatggtaaagttccgcagccgtttattaatagctttaaagaaatgggcgagtggattcgcgtttatggtgaaagcatttatggtacccgcggcggttatctgccgctgcagaaatggggcgcagtgacccagaaaagcggtaaaatttatgtgcatattctgaaaaacaacgagggtaaagccattaccctggaaaaatttccgtttaaaaagattaacagcgcatatctgctgaaagataaaaaaaccgtgaaatataccctgaaaaacaataccctgacctttgatagttatgccgttgatgatcagaatccggatgccgtgattgtgtttgaaggcaagggatccgaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcagacaattggtgttaacgaattaaatggacgtacaggtttatctaaagattatcctgatactcctgaggggaacaaagctttagcagcagccattgtcaaggcatttgtaactgatcgtggtgtcgatggactagatattgatattgagcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggattaa

SEQ ID NO: 198 - protein, 1257 aa, Artificial Sequence
  SYNTHETIC FUSION PROTEN
MGSSHHHHHHSSGLVPRGSHMFSQQKYQPTQANLKARTEFQDEKFGMFIHFGLYSELGRGEWVMNNDKIPVNDYAKLKDFFNPIGFNAKEYVSMAKNAGVKYITLVTRHHDGFSMWNTKYSDFNIMNTPFKRDLVKELANECHKQGVKIAFYYSLLDWTRTDYSYWTGRTGKGTGRTEKGNWNDYIQFMKNQLTELLTNYGEVSGIWFDGYWDQMEEEKAGRSEKTYIDWKMPEIYELIHKLQPQCLVGNNHHITPLEGEDFQMFERDIPGQNEHGLSFQKPSQLPLETCATLNDSWGFDLKDNKNKTFKEFLNLLVNAAGSNANLLMNIGPMPNGKVPQPFINSFKEMGEWIRVYGESIYGTRGGYLPLQKWGAVTQKSGKIYVHILKNNEGKAITLEKFPFKKINSAYLLKDKKTVKYTLKNNTLTFDSYAVDDQNPDAVIVFEGKGSEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQTIGVNELNGRTGLSKDYPDTPEGNKALAAAIVKAFVTDRGVDGLDIDIEHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKD

SEQ ID NO: 199 - DNA, 3774 bp, Artificial Sequence
  SYNTHETIC FUSION PROTEN
atgggcagcagccatcatcatcatcatcacagcagcggcctggtgccgcgcggcagccatatgtttagtcagcagaaatatcagccgacccaggcaaatctgaaagcacgtaccgaatttcaggatgaaaaatttggtatgttcatccatttcggcctgtatagcgaactgggtcgtggcgaatgggttatgaataatgataaaattccggttaacgactacgcaaaactgaaagatttttttaacccgattggctttaacgcaaaagaatatgtgagcatggcaaaaaatgcaggtgttaaatatatcaccctggtgacccgtcatcatgatggttttagcatgtggaataccaaatatagcgattttaacatcatgaacaccccgtttaaacgcgatctggttaaagaactggcaaatgaatgccataaacagggcgtgaaaattgccttttattatagcctgctggattggacccgtaccgattatagttattggaccggccgcaccggtaaaggtaccggccgtaccgaaaaaggtaattggaatgattatatccagttcatgaagaatcagctgaccgaactgctgaccaattatggcgaagttagcggtatttggtttgatggctattgggatcagatggaagaagaaaaagccggtcgtagtgaaaaaacctatattgattggaaaatgccggaaatttacgaactgattcataaactgcagccgcagtgtctggtgggtaataatcatcatattaccccgctggaaggcgaagattttcagatgtttgaacgcgatattccgggccagaatgaacatggtctgagttttcagaaaccgagccagctgccgctggaaacctgcgcaaccctgaatgatagttggggctttgatctgaaagataataaaaataagaccttcaaggagttcctgaatctgctggtgaatgccgcaggtagtaatgccaatctgctgatgaatattggcccgatgccgaatggtaaagttccgcagccgtttattaatagctttaaagaaatgggcgagtggattcgcgtttatggtgaaagcatttatggtacccgcggcggttatctgccgctgcagaaatggggcgcagtgacccagaaaagcggtaaaatttatgtgcatattctgaaaaacaacgagggtaaagccattaccctggaaaaatttccgtttaaaaagattaacagcgcatatctgctgaaagataaaaaaaccgtgaaatataccctgaaaaacaataccctgacctttgatagttatgccgttgatgatcagaatccggatgccgtgattgtgtttgaaggcaagggatccgaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcaggaaattggtgttaacgaattaaatggacgtacaggtttatctaaagattatcctgatactcctgaggggaacaaagctttagcagcagccattgtcaaggcatttgtaactgatcgtggtgtcgatggactagatattgatattgagcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggattaa

SEQ ID NO: 200 - protein, 1257 aa, Artificial Sequence
  SYNTHETIC FUSION PROTEN
MGSSHHHHHHSSGLVPRGSHMFSQQKYQPTQANLKARTEFQDEKFGMFIHFGLYSELGRGEWVMNNDKIPVNDYAKLKDFFNPIGFNAKEYVSMAKNAGVKYITLVTRHHDGFSMWNTKYSDFNIMNTPFKRDLVKELANECHKQGVKIAFYYSLLDWTRTDYSYWTGRTGKGTGRTEKGNWNDYIQFMKNQLTELLTNYGEVSGIWFDGYWDQMEEEKAGRSEKTYIDWKMPEIYELIHKLQPQCLVGNNHHITPLEGEDFQMFERDIPGQNEHGLSFQKPSQLPLETCATLNDSWGFDLKDNKNKTFKEFLNLLVNAAGSNANLLMNIGPMPNGKVPQPFINSFKEMGEWIRVYGESIYGTRGGYLPLQKWGAVTQKSGKIYVHILKNNEGKAITLEKFPFKKINSAYLLKDKKTVKYTLKNNTLTFDSYAVDDQNPDAVIVFEGKGSEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQEIGVNELNGRTGLSKDYPDTPEGNKALAAAIVKAFVTDRGVDGLDIDIEHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKD

SEQ ID NO: 201 - DNA, 3774 bp, Artificial Sequence
  SYNTHETIC FUSION PROTEN
atgggcagcagccatcatcatcatcatcacagcagcggcctggtgccgcgcggcagccatatgtttagtcagcagaaatatcagccgacccaggcaaatctgaaagcacgtaccgaatttcaggatgaaaaatttggtatgttcatccatttcggcctgtatagcgaactgggtcgtggcgaatgggttatgaataatgataaaattccggttaacgactacgcaaaactgaaagatttttttaacccgattggctttaacgcaaaagaatatgtgagcatggcaaaaaatgcaggtgttaaatatatcaccctggtgacccgtcatcatgatggttttagcatgtggaataccaaatatagcgattttaacatcatgaacaccccgtttaaacgcgatctggttaaagaactggcaaatgaatgccataaacagggcgtgaaaattgccttttattatagcctgctggattggacccgtaccgattatagttattggaccggccgcaccggtaaaggtaccggccgtaccgaaaaaggtaattggaatgattatatccagttcatgaagaatcagctgaccgaactgctgaccaattatggcgaagttagcggtatttggtttgatggctattgggatcagatggaagaagaaaaagccggtcgtagtgaaaaaacctatattgattggaaaatgccggaaatttacgaactgattcataaactgcagccgcagtgtctggtgggtaataatcatcatattaccccgctggaaggcgaagattttcagatgtttgaacgcgatattccgggccagaatgaacatggtctgagttttcagaaaccgagccagctgccgctggaaacctgcgcaaccctgaatgatagttggggctttgatctgaaagataataaaaataagaccttcaaggagttcctgaatctgctggtgaatgccgcaggtagtaatgccaatctgctgatgaatattggcccgatgccgaatggtaaagttccgcagccgtttattaatagctttaaagaaatgggcgagtggattcgcgtttatggtgaaagcatttatggtacccgcggcggttatctgccgctgcagaaatggggcgcagtgacccagaaaagcggtaaaatttatgtgcatattctgaaaaacaacgagggtaaagccattaccctggaaaaatttccgtttaaaaagattaacagcgcatatctgctgaaagataaaaaaaccgtgaaatataccctgaaaaacaataccctgacctttgatagttatgccgttgatgatcagaatccggatgccgtgattgtgtttgaaggcaagggatccgaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcagatgattggtgttaacgaattaaatggacgtacaggtttatctaaagattatcctgatactcctgaggggaacaaagctttagcagcagccattgtcaaggcatttgtaactgatcgtggtgtcgatggactagatattgatattgagcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggattaa

SEQ ID NO: 202 - protein, 1257 aa, Artificial Sequence
  SYNTHETIC FUSION PROTEN
MGSSHHHHHHSSGLVPRGSHMFSQQKYQPTQANLKARTEFQDEKFGMFIHFGLYSELGRGEWVMNNDKIPVNDYAKLKDFFNPIGFNAKEYVSMAKNAGVKYITLVTRHHDGFSMWNTKYSDFNIMNTPFKRDLVKELANECHKQGVKIAFYYSLLDWTRTDYSYWTGRTGKGTGRTEKGNWNDYIQFMKNQLTELLTNYGEVSGIWFDGYWDQMEEEKAGRSEKTYIDWKMPEIYELIHKLQPQCLVGNNHHITPLEGEDFQMFERDIPGQNEHGLSFQKPSQLPLETCATLNDSWGFDLKDNKNKTFKEFLNLLVNAAGSNANLLMNIGPMPNGKVPQPFINSFKEMGEWIRVYGESIYGTRGGYLPLQKWGAVTQKSGKIYVHILKNNEGKAITLEKFPFKKINSAYLLKDKKTVKYTLKNNTLTFDSYAVDDQNPDAVIVFEGKGSEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQMIGVNELNGRTGLSKDYPDTPEGNKALAAAIVKAFVTDRGVDGLDIDIEHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKD

SEQ ID NO: 203 - DNA, 3774 bp, Artificial Sequence
  SYNTHETIC FUSION PROTEN
atgggcagcagccatcatcatcatcatcacagcagcggcctggtgccgcgcggcagccatatgtttagtcagcagaaatatcagccgacccaggcaaatctgaaagcacgtaccgaatttcaggatgaaaaatttggtatgttcatccatttcggcctgtatagcgaactgggtcgtggcgaatgggttatgaataatgataaaattccggttaacgactacgcaaaactgaaagatttttttaacccgattggctttaacgcaaaagaatatgtgagcatggcaaaaaatgcaggtgttaaatatatcaccctggtgacccgtcatcatgatggttttagcatgtggaataccaaatatagcgattttaacatcatgaacaccccgtttaaacgcgatctggttaaagaactggcaaatgaatgccataaacagggcgtgaaaattgccttttattatagcctgctggattggacccgtaccgattatagttattggaccggccgcaccggtaaaggtaccggccgtaccgaaaaaggtaattggaatgattatatccagttcatgaagaatcagctgaccgaactgctgaccaattatggcgaagttagcggtatttggtttgatggctattgggatcagatggaagaagaaaaagccggtcgtagtgaaaaaacctatattgattggaaaatgccggaaatttacgaactgattcataaactgcagccgcagtgtctggtgggtaataatcatcatattaccccgctggaaggcgaagattttcagatgtttgaacgcgatattccgggccagaatgaacatggtctgagttttcagaaaccgagccagctgccgctggaaacctgcgcaaccctgaatgatagttggggctttgatctgaaagataataaaaataagaccttcaaggagttcctgaatctgctggtgaatgccgcaggtagtaatgccaatctgctgatgaatattggcccgatgccgaatggtaaagttccgcagccgtttattaatagctttaaagaaatgggcgagtggattcgcgtttatggtgaaagcatttatggtacccgcggcggttatctgccgctgcagaaatggggcgcagtgacccagaaaagcggtaaaatttatgtgcatattctgaaaaacaacgagggtaaagccattaccctggaaaaatttccgtttaaaaagattaacagcgcatatctgctgaaagataaaaaaaccgtgaaatataccctgaaaaacaataccctgacctttgatagttatgccgttgatgatcagaatccggatgccgtgattgtgtttgaaggcaagggatccgaggagaagactgttcaaacaggaaagacagatcagcaggttggtgctaaattggtacaggaaatccgtgaaggaaaacgcggaccactatatgctggttattttaggacatggcatgatcgtgcttcaacaggaatagatggtaaacagcaacatccagaaaatactatggctgaggtcccaaaagaagttgatatcttatttgtttttcatgaccatacagcttcagatagtccattttggtctgaattaaaggacagttatgtccataaattacatcaacagggaacggcacttgttcagacaattggtgttaacgaattaaatggacgtacaggtttatctaaagattatcctgatactcctgaggggaacaaagctttagcagcagccattgtcaaggcatttgtaactgatcgtggtgtcgatggactagatattatgattgagcacgaatttacgaacaaaagaacacctgaagaagatgctcgtgctctaaatgtttttaaagagattgcgcagttaataggtaaaaatggtagtgataaatctaaattgctcatcatggacactaccctaagtgttgaaaataatccaatatttaaagggatagcggaagatcttgattatcttcttagacaatattatggttcacaaggtggagaagctgaagtggatactataaactctgattggaaccaatatcagaattatattgatgctagccagttcatgattggattctccttttttgaagaatctgcgtccaaagggaatttatggtttgatgttaacgaatacgaccctaacaatcctgaaaaagggaaagatattgaaggaacacgtgctaaaaaatatgcagagtggcaacctagtacaggtggtttaaaagcaggtatattctcttatgctattgatcgtgatggagtggctcatgttccttcaacatataaaaataggactagtacaaatttacaacggcatgaagtcgataatatctcacatactgactacaccgtatctcgaaaattaaaaacattgatgaccgaagacaaacgctatgatgtcattgatcaaaaagacattcctgacccagcattaagagaacaaatcattcaacaagttggacagtataaaggcgatttggaacgttataacaagacattggtgcttacaggagataagattcaaaatcttaaaggactagaaaaattaagcaagttacaaaaattagagttgcgccagctatctaacgttaaagaaattactccagaacttttgccggaaagcatgaaaaaagatgctgagcttgttatggtaggcatgactggtttagaaaaactaaaccttagtggtctaaatcgtcaaactttagacggtatagacgtgaatagtattacgcatttgacatcatttgatatttcacataatagtttggacttgtcggaaaagagtgaagaccgtaaactattaatgactttgatggagcaggtttcaaatcatcaaaaaataacggtgaaaaatacggcttttgaaaatcaaaaaccgaaaggttattatcctcagacgtatgataccaaagaaggtcattatgatgttgataatgcagaacatgatattttaactgattttgtttttggaactgttactaaacgtaatacctttattggagacgaagaagcatttgctatctataaagaaggagctgtcgatggtcgacaatatgtgtctaaagactatacttatgaagcttttcgtaaagactataaaggttacaaggttcatttaactgcttctaacctaggagaaacagttacttctaaggtaactgctactactgatgaaacttacttagtagatgtttctgatggggaaaaagttgttcaccacatgaaactcaatataggatctggtgccatcatgatggaaaatctggcaaaaggggctaaagtgattggtacatctggggactttgagcaagcaaagaagattttcgatggtgaaaagtcagatagattcttcacttggggacaaactaactggatagcttttgatctaggagaaattaatcttgcgaaggaatggcgtttatttaatgcagagacaaatactgaaataaagacagatagtagcttaaacgtggctaaaggacgtcttcagattttaaaagatacaactattgatttagaaaaaatggacataaaaaatcgtaaagagtatctgtcgaatgatgaaaattggactgatgttgctcagatggatgatgcaaaagcgatatttaatagtaaattatccaatgttttatctcggtattggcggttttgtgtagatggtggagctagctcttattaccctcaatataccgaacttcaaatcctcggacaacgtttatcaaatgatgtcgctaatacgctgaaggattaa

SEQ ID NO: 204 - protein, 1257 aa, Artificial Sequence
  SYNTHETIC FUSION PROTEN
MGSSHHHHHHSSGLVPRGSHMFSQQKYQPTQANLKARTEFQDEKFGMFIHFGLYSELGRGEWVMNNDKIPVNDYAKLKDFFNPIGFNAKEYVSMAKNAGVKYITLVTRHHDGFSMWNTKYSDFNIMNTPFKRDLVKELANECHKQGVKIAFYYSLLDWTRTDYSYWTGRTGKGTGRTEKGNWNDYIQFMKNQLTELLTNYGEVSGIWFDGYWDQMEEEKAGRSEKTYIDWKMPEIYELIHKLQPQCLVGNNHHITPLEGEDFQMFERDIPGQNEHGLSFQKPSQLPLETCATLNDSWGFDLKDNKNKTFKEFLNLLVNAAGSNANLLMNIGPMPNGKVPQPFINSFKEMGEWIRVYGESIYGTRGGYLPLQKWGAVTQKSGKIYVHILKNNEGKAITLEKFPFKKINSAYLLKDKKTVKYTLKNNTLTFDSYAVDDQNPDAVIVFEGKGSEEKTVQTGKTDQQVGAKLVQEIREGKRGPLYAGYFRTWHDRASTGIDGKQQHPENTMAEVPKEVDILFVFHDHTASDSPFWSELKDSYVHKLHQQGTALVQTIGVNELNGRTGLSKDYPDTPEGNKALAAAIVKAFVTDRGVDGLDIMIEHEFTNKRTPEEDARALNVFKEIAQLIGKNGSDKSKLLIMDTTLSVENNPIFKGIAEDLDYLLRQYYGSQGGEAEVDTINSDWNQYQNYIDASQFMIGFSFFEESASKGNLWFDVNEYDPNNPEKGKDIEGTRAKKYAEWQPSTGGLKAGIFSYAIDRDGVAHVPSTYKNRTSTNLQRHEVDNISHTDYTVSRKLKTLMTEDKRYDVIDQKDIPDPALREQIIQQVGQYKGDLERYNKTLVLTGDKIQNLKGLEKLSKLQKLELRQLSNVKEITPELLPESMKKDAELVMVGMTGLEKLNLSGLNRQTLDGIDVNSITHLTSFDISHNSLDLSEKSEDRKLLMTLMEQVSNHQKITVKNTAFENQKPKGYYPQTYDTKEGHYDVDNAEHDILTDFVFGTVTKRNTFIGDEEAFAIYKEGAVDGRQYVSKDYTYEAFRKDYKGYKVHLTASNLGETVTSKVTATTDETYLVDVSDGEKVVHHMKLNIGSGAIMMENLAKGAKVIGTSGDFEQAKKIFDGEKSDRFFTWGQTNWIAFDLGEINLAKEWRLFNAETNTEIKTDSSLNVAKGRLQILKDTTIDLEKMDIKNRKEYLSNDENWTDVAQMDDAKAIFNSKLSNVLSRYWRFCVDGGASSYYPQYTELQILGQRLSNDVANTLKD

---

What is claimed is:

1. A fusion protein comprising a fucosidase fused with either an N-terminal end or a C-terminal end of an endoglycosidase or a fragment or a mutant thereof having endoglycosidase activity; wherein the fusion protein exhibits both fucosidase activity and the endoglycosidase activity;
   wherein the fucosidase is selected from the group consisting of *Lactobacillus casei* α-L fucosidase C (Alfc), *Bacteroides fragilis* fucosidase (BF3242), *Bacteroides thetaiotaomicron* α-L-fucosidase (BT2970), *Emticicia oligotrophica* α-L-fucosidase (EO0918) and *Elizabethkingia miricola* α-(1-6) fucosidase (Emfuc3); and
   wherein the endoglycosidase is selected from the group consisting of *Streptococcus pyogenes* endoglycosidase S, a truncated fragment of *Streptococcus pyogenes* endoglycosidase S comprising an immunoglobulin G (IgG) binding domain thereof, a mutant of *Streptococcus pyogenes* endoglycosidase S having a mutation at amino acid position D233, wild type *Streptococcus pyogenes* endoglycosidase S2, a truncated fragment of *Streptococcus pyogenes* endoglycosidase S2 comprising an immunoglobulin G (IgG) binding domain thereof, and a mutant of *Streptococcus pyogenes* endoglycosidase S2 having a mutation at amino acid position T138, D182, D184, E186, D226, or T227, wherein the wild type *Streptococcus pyogenes* endoglycosidase S2 comprises the amino acid sequence of SEQ ID NO: 26 at positions 463 to 1307.

2. The fusion protein of claim 1, wherein the fucosidase is *Lactobacillus casei* α-L fucosidase C or *Elizabethkingia miricola* α-(1-6) fucosidase (Emfuc3).

3. The fusion protein of claim 1, wherein the endoglycosidase is the *Streptococcus pyogenes* endoglycosidase S mutant and the mutation at amino acid position D233 is, D233Q.

4. The fusion protein of claim 1, wherein the endoglycosidase is the *Streptococcus pyogenes* endoglycosidase S2 mutant and the mutation at amino acid position of the *Streptococcus pyogenes* endoglycosidase S2 mutant is T138E, T138M, T138Q, T138R, T138M, T138L, T138H, T138N, T138K, D182Q, D184M, D184Q, D184T, D184L, D184F, D184 S, D184V, D184K, D184W, E186A, D226Q, or T227Q.

5. The fusion protein of claim 1, which comprises *Elizabethkingia miricola* α-(1-6) fucosidase fused with *Streptococcus pyogenes* endoglycosidase S, the wild type *Streptococcus pyogenes* endoglycosidase S2 having the amino acid of SEQ ID NO. 26 at positions 463 to 1307, an IgG binding domain of *Streptococcus pyogenes* endoglycosidase S, an IgG binding domain of *Streptococcus pyogenes* endoglycosidase 2, *Streptococcus pyogenes* endoglycosidase S having a mutation at amino acid position D233, *Streptococcus pyogenes* endoglycosidase S2 having a mutation at amino acid position T138, *Streptococcus pyogenes* endoglycosidase S2 having a mutation at amino acid position D182, *Streptococcus pyogenes* endoglycosidase S2 having a mutation at amino acid position D184, *Streptococcus pyogenes* endoglycosidase S2 having a mutation at amino acid position E186, *Streptococcus pyogenes* endoglycosidase S2 having a mutation at amino acid position D226 or *Streptococcus pyogenes* endoglycosidase S2 having a mutation at amino acid position T227.

6. The fusion protein of claim 1, which comprises an amino acid sequence selected from the group consisting of SEQ ID NOs: 36, 44, 46, 48, 50, 62, 64, 84, and 92 or a peptide having at least 95% sequence identity with the amino acid sequence of SEQ ID Nos: 36, 42, 46, 48, 50, 62, 64, 84 and 92.

7. The fusion protein of claim 1, which comprises an amino acid sequence selected from the group consisting of SEQ ID NOs: 44, 46, 48, 50, 62, and 92.

8. A method for remodeling a glycan of an antibody Fc region comprising the following steps: obtaining an antibody that has a heterogeneous glycan in the Fc region of the antibody and contacting the antibody with the fusion protein of claim 1.

9. The method of claim 8, comprising providing an antibody having a heterogeneous glycan in the Fc region thereof, a fusion protein of claim 1 and a target glycan oxazoline, wherein the glycan of the antibody Fc region comprises a N-acetylglucosamine (GlcNAc) residue; and contacting the antibody with the fusion protein of claim 1 and the target glycan oxazoline linking to the antibody Fc region;

whereby a remodeled glycan of the antibody Fc region can be obtained.

10. The method of claim 9, which further comprises purifying the antibody having the remodeled glycan in the Fc region.

11. The method of claim 8, wherein the remodeled glycan is $Sia_2(\alpha2\text{-}6)Gal_2GlcNAc_2Man_3GlcNAc_2$, $Sia_2(\alpha2\text{-}6)Gal_2GlcNAc_3Man_3GlcNAc_2$, $Sia_2(\alpha2\text{-}3)Gal_2GlcNAc_2Man_3GlcNAc_2$, $Sia_2(\alpha2\text{-}3)Gal_2GlcNAc_3Man_3GlcNAc_2$, $Sia_2(\alpha2\text{-}3/\alpha2\text{-}6)Gal_2GlcNAc_2Man_3GlcNAc_2$, $Sia_2(\alpha2\text{-}6/\alpha2\text{-}3)Gal_2GlcNAc_2Man_3GlcNAc_2$, $Sia_2(\alpha2\text{-}3/\alpha2\text{-}6)Gal_2GlcNAc_3Man_3GlcNAc_2$, $Sia_2(\alpha2\text{-}6/\alpha2\text{-}3)Gal_2GlcNAc_3Man_3GlcNAc_2$, $Sia(\alpha2\text{-}6)Gal_2GlcNAc_2Man_3GlcNAc_2$, $Sia(\alpha2\text{-}3)Gal_2GlcNAc_2Man_3GlcNAc_2$, $Sia(\alpha2\text{-}6)Gal_2GlcNAc_3Man_3GlcNAc_2$, $Sia(\alpha2\text{-}3)Gal_2GlcNAc_3Man_3GlcNAc_2$, $Sia(\alpha2\text{-}6)GalGlcNAc_2Man_3GlcNAc_2$, $Sia(\alpha2\text{-}3)GalGlcNAc_2Man_3GlcNAc_2$, $Sia(\alpha2\text{-}6)GalGlcNAc_3Man_3GlcNAc_2$, $Sia(\alpha2\text{-}3)GalGlcNAc_3Man_3GlcNAc_2$, $Gal_2GlcNAc_2Man_3GlcNAc_2$, $GalGlcNAcMan_3GlcNAc_2$, $Gal_2GlcNAc_3Man_3GlcNAc_2$, $GalGlcNAc_2Man_3GlcNAc_2$, $GalGlcNAc_3Man_3GlcNAc_2$, $GlcNAc_3Man_3GlcNAc_2$, $GlcNAc_2Man_3GlcNAc_2$, $GlcNAcMan_3GlcNAc_2$, or $Man_3GlcNAc_2$.

12. The fusion protein of claim 1, wherein the fucosidase and endoglycosidase are selected such that the fucosidase activity of the fusion protein in removing fucose from trastuzumab (TRZ) is greater than a fucosidase activity of the fucosidase alone.

13. The fusion protein of claim 12, wherein the fucosidase is *Lactobacillus casei* α-L fucosidase C (Alfc).

14. The fusion protein of claim 12, wherein the fucosidase is *Elizabethkingia miricola* α-(1-6) fucosidase (Emfuc3).

* * * * *